(12) United States Patent
Madison et al.

(10) Patent No.: US 9,145,552 B2
(45) Date of Patent: Sep. 29, 2015

(54) MODIFIED FACTOR X POLYPEPTIDES AND USES THEREOF

(71) Applicants: Edwin L. Madison, San Francisco, CA (US); Christopher Thanos, San Francisco, CA (US)

(72) Inventors: Edwin L. Madison, San Francisco, CA (US); Christopher Thanos, San Francisco, CA (US)

(73) Assignee: Catalyst Biosciences, Inc., South San Francisco, CA (US)

( * ) Notice: Subject to any disclaimer, the term of this patent is extended or adjusted under 35 U.S.C. 154(b) by 0 days.

(21) Appl. No.: 13/815,768

(22) Filed: Mar. 15, 2013

(65) Prior Publication Data

US 2014/0030247 A1    Jan. 30, 2014

Related U.S. Application Data

(60) Provisional application No. 61/741,806, filed on Jul. 25, 2012.

(51) Int. Cl.
| | |
|---|---|
| *A61K 38/00* | (2006.01) |
| *A61K 38/36* | (2006.01) |
| *A61K 38/43* | (2006.01) |
| *C12N 9/64* | (2006.01) |
| *A61K 38/48* | (2006.01) |

(52) U.S. Cl.
CPC .............. *C12N 9/6432* (2013.01); *A61K 38/36* (2013.01); *A61K 38/482* (2013.01); *A61K 38/4846* (2013.01)

(58) Field of Classification Search
None
See application file for complete search history.

(56) References Cited

U.S. PATENT DOCUMENTS

| | | | |
|---|---|---|---|
| 4,501,731 A | 2/1985 | Tishkoff et al. | 424/530 |
| 4,522,811 A | 6/1985 | Eppstein et al. | 514/2.4 |
| 4,892,538 A | 1/1990 | Aebischer et al. | 604/891.1 |
| 4,952,496 A | 8/1990 | Studier et al. | 435/91.41 |
| 5,283,187 A | 2/1994 | Aebischer et al. | 435/182 |
| 5,323,907 A | 6/1994 | Kalvelage | 206/531 |
| 5,580,560 A | 12/1996 | Nicolaisen et al. | 424/94.64 |
| 5,968,897 A | 10/1999 | Wolf et al. | 514/2 |
| 5,990,079 A | 11/1999 | Wolf et al. | 514/13.7 |
| 6,017,882 A | 1/2000 | Nelsestuen | 514/14.9 |
| 6,562,598 B1 | 5/2003 | Himmelspach et al. | 435/69.6 |
| 6,573,071 B1 | 6/2003 | Himmelspach et al. | 435/69.6 |
| 6,660,492 B1 | 12/2003 | Bode et al. | 435/23 |
| 6,670,147 B1 | 12/2003 | Heidtmann et al. | 435/69.1 |
| 6,905,846 B2 | 6/2005 | Himmelspach et al. | 435/69.1 |
| 6,958,322 B1 | 10/2005 | Himmelspach et al. | 514/13.7 |
| 7,078,508 B2 | 7/2006 | Francischetti et al. | 536/23.1 |
| 7,220,569 B2 | 5/2007 | Himmelspach et al. | 435/252.3 |
| 7,645,602 B2 | 1/2010 | Stafford et al. | 435/189 |
| 8,048,990 B2 | 11/2011 | Nelsestuen | 530/380 |
| 8,153,590 B2 | 4/2012 | Lu et al. | 424/192.1 |
| 8,211,428 B2 | 7/2012 | Madison | 424/94.64 |
| 8,383,386 B2 | 2/2013 | Camire et al. | 424/450 |
| 8,445,245 B2 | 5/2013 | Ruggles et al. | 435/183 |
| 8,519,103 B2 | 8/2013 | Madison et al. | 530/384 |
| 8,663,633 B2 | 3/2014 | Madison et al. | 424/94.64 |
| 2003/0119168 A1 | 6/2003 | Madison | 435/226 |
| 2003/0134298 A1 | 7/2003 | Madison | 435/6.16 |
| 2003/0134794 A1 | 7/2003 | Madison | 435/226 |
| 2003/0138914 A1 | 7/2003 | Himmelspach et al. | 435/69.1 |
| 2003/0143219 A1 | 7/2003 | Madison et al. | 424/94.76 |
| 2003/0186329 A1 | 10/2003 | Madison et al. | 435/7.1 |
| 2003/0207402 A1 | 11/2003 | Kopetzki et al. | 435/69.1 |
| 2004/0001801 A1 | 1/2004 | Madison | 424/85.1 |
| 2004/0146938 A1 | 7/2004 | Nguyen et al. | 435/7.1 |
| 2005/0112579 A1 | 5/2005 | Madison | 424/6.16 |
| 2005/0142032 A1 | 6/2005 | Hoenes et al. | 422/400 |
| 2006/0029590 A1 | 2/2006 | Thanos | 424/94.63 |
| 2006/0148038 A1 | 7/2006 | Louvain et al. | 435/69.6 |
| 2006/0269538 A1 | 11/2006 | Kolterman | 424/94.63 |
| 2007/0093443 A1 | 4/2007 | Madison | 514/44 |
| 2009/0053185 A1 | 2/2009 | Schulte et al. | 514/1.1 |
| 2009/0098103 A1 | 4/2009 | Madison | 424/94.64 |
| 2009/0098119 A1 | 4/2009 | Lu et al. | 424/192.1 |
| 2009/0123452 A1 | 5/2009 | Madison | 424/94.64 |
| 2009/0136477 A1 | 5/2009 | Nguyen | 424/94.64 |
| 2009/0175828 A1 | 7/2009 | Schulte et al. | 424/93.2 |
| 2009/0175931 A1 | 7/2009 | Camire et al. | 424/450 |
| 2009/0291890 A1 | 11/2009 | Madison | 514/14.3 |
| 2010/0125052 A1 | 5/2010 | Lu et al. | 514/14.3 |
| 2010/0166729 A9 | 7/2010 | Madison | 424/94.64 |
| 2010/0255000 A1 | 10/2010 | Sinha et al. | 424/158.1 |
| 2010/0285568 A1 | 11/2010 | Soejima et al. | 435/212 |
| 2011/0015128 A1 | 1/2011 | Sinha et al. | 513/13.7 |
| 2011/0293597 A1 | 12/2011 | Christophe et al. | 424/94.64 |
| 2012/0244139 A1 | 9/2012 | Madison et al. | 424/94.63 |

(Continued)

FOREIGN PATENT DOCUMENTS

| | | |
|---|---|---|
| WO | WO 92/06203 | 4/1992 |
| WO | WO 96/00577 | 1/1996 |

(Continued)

OTHER PUBLICATIONS www.sigmaaldrich.com "Amino Acids Reference Chart" 2014, 4 pages.*
http://hyperphysics.phy-str. Amino Acid Structures, 2014, 4 pages.*
www.russelllab.org/aas/ "Amino acid properties", 3 pages, 2003.*
Jonson & Peterson, A critical view on conservative mutations, Prot. Eng. 14/6, 397-402 (2001).*
James Wells, Additivity of Mutational Effects in Proteins, Biochem 29/37, pp. 8509-8517 (1990).*
Letter/Written Disclosure of the Information Disclosure Statement for the above-referenced application, mailed on Mar. 13, 2014, 2 pages.

(Continued)

*Primary Examiner* — Karlheinz R Skowronek
*Assistant Examiner* — Joseph Fischer
(74) *Attorney, Agent, or Firm* — Dentons US LLP; Stephanie Seidman

(57) ABSTRACT

Modified therapeutic proteins are provided. In particular modified Factor X polypeptides, which includes the Factor X zymogen, Factor Xa and other forms of Factor X, and uses thereof are provided.

29 Claims, 14 Drawing Sheets

(56) References Cited

U.S. PATENT DOCUMENTS

| | | |
|---|---|---|
| 2012/0301945 A1 | 11/2012 | Madison et al. ............... 435/219 |
| 2012/0308540 A1 | 12/2012 | Madison et al. ........... 424/93.72 |
| 2012/0308551 A1 | 12/2012 | Madison ..................... 424/94.64 |
| 2013/0164820 A9 | 6/2013 | Madison ........................ 435/219 |
| 2013/0177541 A9 | 7/2013 | Madison et al. ........... 424/93.72 |
| 2013/0243855 A1 | 9/2013 | Oyhenart et al. ............. 424/463 |
| 2014/0044701 A1 | 2/2014 | Madison et al. ............... 530/384 |
| 2014/0234290 A1 | 8/2014 | Madison et al. ................ 514/1.1 |
| 2014/0248259 A1 | 9/2014 | Camire ..................... 424/96.64 |

FOREIGN PATENT DOCUMENTS

| | | |
|---|---|---|
| WO | WO 98/38317 | 9/1998 |
| WO | WO 98/38318 | 9/1998 |
| WO | WO 98/39456 | 9/1998 |
| WO | WO 01/10896 | 2/2001 |
| WO | WO 02/095007 | 11/2002 |
| WO | WO 03/035861 | 5/2003 |
| WO | WO 2004/005347 | 1/2004 |
| WO | WO 2004/031733 | 4/2004 |
| WO | WO 2005/023308 | 3/2005 |
| WO | WO 2006/125827 | 11/2006 |
| WO | WO 2006/128668 | 12/2006 |
| WO | WO 2007/059513 | 5/2007 |
| WO | WO 2011/008885 | 1/2011 |
| WO | WO 2013/049804 | 4/2013 |
| WO | WO 2014/018120 | 1/2014 |

OTHER PUBLICATIONS

Al-Tamimi et al. "Coagulation-induced shedding of platelet glycoprotein VI mediated by factor Xa," Blood 117:3912-3920 (2011).

Bode et al., "Comparative Analysis of Haemostatic Proteinases: Structural Aspects of Thrombin, Factor Xa, Factor IXa and Protein C," Thrombosis ad Haemostais 78:501-511 (1997).

Rohlena et al., "Chapter III: Role of surface loop 340-347 in the catalytic activity of human blood coagulation factor IX," in thesis entitled "Molecular interactions between coagulation factor IX and low density lipoprotein receptor-related protein," Univ. of Utrecht, pp. 37-48 (2004).

Ruf, W., "Factor VIIa residue Arg290 is required for efficient activation of the macromolecular substrate factor X," Biochem. 33:11631-11636 (1994).

International Search Report and Written Opinion, issued Oct. 25, 2013, in connection with corresponding International Patent Application No. PCT/US2013/032616, 12 pages.

Letter/Written Disclosure of the Information Disclosure Statement for the above-referenced application, mailed on May 30, 2014, 2 pages.

Response to Chapter II Demand under Article 31, filed May 23, 2014, in connection with corresponding International Patent Application No. PCT/US2013/032616, 81 pages.

Letter/Written Disclosure of the Supplemental Information Disclosure Statement for the above-referenced application, mailed herewith on Jun. 5, 2014, 2 pages.

International Search Report, issued Jan. 2, 2013, in connection with International Patent Application No. PCT/US2012/58279, 3 pages.

International Preliminary Report on Patentability, issue Apr. 1, 2014, in connection with International Patent Application No. PCT/US2012/58279, 10 pages.

Letter/Written Disclosure of the Information Disclosure Statement for the above-referenced application, mailed on Aug. 19, 2013, 3 pages.

Abuchowski et al., "Immunosuppressive properties and circulating life of *Achromobacter* glutaminase-asparaginase covalently attached to polyethylene glycol in man," Cancer Treat Rep. 65(11-12):1077-1081 (1981).

Abuchowski et al., "Reduction of plasma urate levels in the cockerel with polyethylene glycol-uricase." J Pharmacol Exp Ther. 219(2):352-324 (1981).

Adams et al., "The c-myc oncogene driven by immunoglobulin enhancers induces lymphoid malignancy in transgenic mice," Nature 318:533-538 (1985).

Akhavan et al., "Recurrence of a Phe31Ser mutation in the Gla domain of blood coagulation factor X, in unrelated Algerian families: a founder effect?" Eur J Haematol. 78(5):405-409 (2007).

Alexander et al., "Expression of the c-myc oncogene under control of an immunoglobulin enhancer in Eµ-myc transgenic mice," Mol. Cell. Biol. 7(4):1436-1444 (1987).

Al-Hilali et al., "Analysis of the novel factor X gene mutation Glu51Lys in two families with factor X-Riyadh anomaly," Thromb. Haemost. 97:542-545 (2007).

Altieri, D., "Coagulation assembly on leukocytes in transmembrane signaling and cell adhesion," Blood 81:569-579 (1993).

Altieri, D., "Proteases and protease receptors in modulation of leukocyte effector functions," J. Leukocyte Biol. 58:120-127 (1995).

Altieri, D., "Xa receptor EPR-1." FASEB J 9:860-865 (1995).

Altschul et al., "Basic local alignment search tool," J. Mol. Biol. 215:403-310 (1990).

Ambrosini, G., and D. Altieri, "Molecular dissection of effector cell protease receptor-1 recognition of factor Xa. Assignment of critical residues involved in antibody reactivity and ligand binding," J. Biol. Chem. 271:1243-1248 (1996).

Ambrosini et al., "Activation-dependent exposure of the inter-EGF sequence Leu83-Leu88 in factor Xa mediates ligand binding to effector cell protease receptor-1," J. Biol. Chem. 272(13):8340-8345 (1997).

Au et al., "Two novel factor X gene mutations in a Chinese family with factor X deficiency," Ann Hematol. 83(5):304-306 (2004).

Benoist et al., "In vivo sequence requirements of the SV40 early promoter region," Nature 290:304-310 (1981).

Bereczky et al., "Factor XDebrecen: Gly204Arg mutation in factor X causes the synthesis of a non-secretable protein and severe factor X deficiency," Haematologica. 93(2):299-302 (2008).

Bergum et al., "Role of zymogen and activated factor X as scaffolds for the inhibition of the blood coagulation factor VIIa-tissue factor complex by recombinant nematode anticoagulant protein c2," J Biol Chem. 276(13):10063-10071 (2001).

Bernardi et al., "Topologically equivalent mutations causing dysfunctional coagulation factors VII (294Ala—>Val) and X (334Ser—>Pro)," Hum Mol Genet. 3(7):1175-1177 (1994).

Bezeaud et al., "Functional consequences of the Ser334—>Pro mutation in a human factor X variant (factor XMarseille)," Eur. J. Biochem. 234:140-147 (1995).

Bi et al., "Targeted disruption of the mouse factor VIII gene produces a model of haemophilia A," Nat Gen 10:119-121 (1995).

Bianchini et al., "The elusive role of the potential factor X cation-binding exosite-1 in substrate and inhibitor interactions," J Biol. Chem., 279:3671-3679 (2004).

Bock et al., "Exosites in the substrate specificity of blood coagulation reactions." J. Thromb. Haemost., 5:81-94 (2007).

Bock et al., "Isolation of human blood coagulation α-factor Xa by soybean trypsin inhibitor-sepharose chromatography and its active-site titration with fluorescein mono-p-guanidinobenzoate," Arch. Biochem. Biophys. 273(2):375-388 (1989).

Bode et al., "The refined 1.9-A X-ray crystal structure of D-Phe-Pro-Arg chloromethylketone-inhibited human α-thrombin: Structure analysis, overall structure, electrostatic properties, detailed active-site geometry, and structure-function relationships," Protein Science 1:426-471 (1992).

Bolton-Maggs, P., "The rare coagulation disorders," The Treatment of Hemophilia. Manchester: World Federation of Hemophilia, 17 pages (2006).

Bono et al., "Human umbilical vein endothelial cells express high affinity receptors for factor Xa," J. Cell. Physiol. 172:36-43 (1997).

Bouchard et al., "Effector cell protease receptor-1, a platelet activation-dependent membrane protein, regulates prothrombinase-catalyzed thrombin generation," J. Biol. Chem. 272:9244-9251 (1997).

Brenner et al., "A missense mutation in gamma-glutamyl carboxylase gene causes combined deficiency of all vitamin K-dependent blood coagulation factors," Blood. 92:4554-4559 (1998).

(56) References Cited

OTHER PUBLICATIONS

Brinkhous et al., "Effect of recombinant factor VIIa on the hemostatic defect in dogs with hemophilia A, hemophilia B, and von Willebrand disease," PNAS 86:1382-1386 (1989).
Brinster et al., "Regulation of metallothionein-thymidine kinase fusion plasmids injected into mouse eggs," Nature 296:39-42 (1982).
Brown et al., "Codon utilisation in the pathogenic yeast, Candida albicans," Nucleic Acids Research, 19:4298 (1991).
Brown, D. and P. Kouides, "Diagnosis and treatment of inherited factor X deficiency," Haemophilia. 14(6):1176-1182 (2008).
Broze et al., "Regulation of coagulation by a multivalent Kunitz-type inhibitor," Biochemistry, 7539-7546 (1990).
Broze et al., "The lipoprotein-associated coagulation inhibitor that inhibits the factor VII-tissue factor complex also inhibits factor Xa: insight into its possible mechanism of action." Blood, 71(2):335-343 (1988).
Bunce et al., "Zymogen-like factor Xa variants restore thrombin generation and effectively bypass the intrinsic pathway in vitro," Blood, 117:290-298 (2011).
Burri et al., "Molecular interactions of the intrinsic activation complex of coagulation: binding of native and activated human factors IX and X to defined phospholipid vesicles," Biochimica et Biophysica Acta. 923(2):176-186 (1987).
Butenas, S. and K. Mann, "Kinetics of human factor VII activation." Biochemistry, 35(6):1904-1910 (1996).
Camerer et al., "Coagulation factors VIIa and Xa induce cell signaling leading to up-regulation of the egr-1 gene," J. Biol. Chem. 274:32225-32233 (1999).
Camire et al., "Enhanced gamma-carboxylation of recombinant factor X using a chimeric construct containing the prothrombin propeptide," Biochemistry.39(46):14322-14329 (2000).
Camire et al., "Prothrombinase assembly and S1 site occupation restore the catalytic activity of Fxa impaired by mutation at the sodium-binding site," J. Biol. Chem. 277:37863-37870 (2002).
Camire, R., "Bioengineered factor Xa as a potential new strategy for hemophilia therapy," Expert Rev. Hematol. 5(2):121-123 (2012).
Canadian Agency for Drugs and Technologies in Health, "Anticoagulation monitoring and reversal strategies for Dabigatran, Rivaroxaban, and Apixaban: A review of clinical effectiveness," Published Apr. 2012 [online] Retrieved from:<URL:canadianopenlibrary.ca/SwfDocs/234/234906.pdf, 19 pages.
Cargill et al., "Characterization of single-nucleotide polymorphisms in coding regions of human genes," Nat. Gen., 22:231-238 (1999).
Carrillo et al., "The multiple sequence alignment problem in biology," SIAM J. Appl. Math. 48:1073-1082 (1988).
Chafa et al.,"Characterization of a homozygous Gly11Val mutation in the Gla domain of coagulation factor X," Thromb. Res. 124:144-148 (2009).
Chan et al., "Assessment of recombinant factor VIIa as an antidote for bleeding induced in the rabbit by low molecular weight heparin," J. Thromb. Haemost. 1:760-765 (2003).
Chen et al., "Zymogenic and enzymatic properties of the 70-80 loop mutants of factor X/Xa," Protein Sci. 13(2):431-442 (2004).
Cirino et al., "Factor Xa as an interface between coagulation and inflammation. Molecular mimicry of factor Xa association with effector cell protease receptor-1 induces acute inflammation in vivo," J. Clin. Invest. 99(10):2446-2451 (1997).
Clinicaltrials.gov, "Clinical Trial Record NCT00930176," [retrieved on Apr. 29, 2013] Published on Oct. 11, 2005 [online] Retrieved from:<URL:clinicaltrials.gov/ct2/show/study/NCT00930176?term=NCT00930176&rank=1>, 3 pages.
Clinicaltrials.gov, "Clinical Trial Record NCT01086852," [retrieved on Apr. 29, 2013] Published on Nov. 10, 2009 [online] Retrieved from:<URL:clinicaltrials.gov/ct2/show/NCT01086852?term=NCT01086852&rank=1>, 3 pages, 3 pages.
Cook et al., "Directed glycosylation of human coagulation factor X at residue 333. Insight into factor Va-dependent prothrombin catalysis," J. Biol. Chem. 275(49):38774-38779 (2000).
Cooper et al., "Inherited factor X deficiency: molecular genetics and pathophysiology," Thromb Haemost. 78(1):161-172 (1997).
Craik et al., "Proteases as therapeutics," Biochem. J. 435:1-16 (2011).
DeBoer et al., "The tac promoter: a functional hybrid derived from the trp and lac promoters," Proc. Natl. Acad. Sci. U.S.A. 80:21-25 (1983).
De Stefano et al., "Factor X Roma: a congenital factor X variant defective at different degrees in the intrinsic and the extrinsic activation," Br J Haematol. 69(3):387-391 (1988).
Deam et al., "F X Nottingham and F X Taunton. Two novel mutations in factor X resulting in loss of functional activity and an interpretation using molecular modelling," Thromb Heamost 85(2):265-269 (2001).
Deam et al., "Factor X Leicester: Ile411Phe associated with a low antigen level and a disproportionately low functional activity of factor X," J. Thromb. Haemost. 1(3):603-605 (2003).
Deam et al., "Two new factor X mutations (Pro382Leu and Phe356Cys) associated with low activity and low antigen levels," Thromb Haemost. 92:1161- 1163 (2004).
Devereux et al., "A comprehensive set of sequence analysis programs for the VAX," Nucleic Acids Res. 12(1):387-395 (1984).
Di Scipio et al., "A comparison of human prothrombin, factor IX (Christmas factor), factor X (Stuart factor), and protein S," Biochemistry, 16:698-706 (1977).
Dickneite et al., "Prothrombin complex concentrate versus recombinant factor VIIa for reversal of hemodilutional coagulopathy in a porcine trauma model," J Trauma 68(5):1151-1157 (2010).
Dickneite, G. and I. Pragst, "Prothrombin complex concentrate vs fresh frozen plasma for reversal of dilutional coagulopathy in a porcine trauma model," Br J Anaesth 102(3):345-354 (2009).
Diness et al., "Recombinant human factor VIIa (rFVIIa) in a rabbit stasis model," Thromb. Res 67:233-241 (1992).
Doyle, M. and K. Mann, "Multiple active forms of thrombin. IV. Relative activities of meizothrombins," J. Biol. Chem., 265(18):10693-10701 (1990).
Eaton et al., "Proteolytic processing of human factor VIII. Correlation of specific cleavages by thrombin, factor Xa, and activated protein C with activation and inactivation of factor VIII coagulant activity," Biochemistry, 25(2):505-512 (1986).
Eisenberg et al., "Hydrophobic moments and protein structure," Faraday Symp. Chem. Soc. 17:109-120 (1982).
Elg et al., "Effect of activated prothrombin complex concentrate or recombinant factor VIIa on the bleeding time and thrombus formation during anticoagulation with a direct thrombin inhibitor," Thromb. Res. 101:145-157 (2001).
Erb et al., "Interaction of bovine coagulation factor X and its glutamic-acid-containing fragments with phospholipid membranes. A surface plasmon resonance study," Eur. J. Biochem. 269(12):3041-3046 (2002).
Esmon, C. and W. Owen, "Identification of an endothelial cell cofactor for thrombin-catalyzed activation of protein C," Proc. Natl. Acad. Sci. USA, 78:2249-2252 (1981).
Esmon, C., "Cell mediated events that control blood coagulation and vascular injury," Annu Rev Cell Biol. 9:1-26 (1993).
Exner et al., "A new activated factor X-based clotting method with improved specificity for procoagulant phospholipid," Blood Coagul Fibrinolysis. 14(9:773-779 (2000).
Fair et al., "Isolation and characterization of the factor X Friuli variant," Blood. 73(8):2108-2116 (1989).
Fattorutto et al., "Recombinant activated factor VII decreases bleeding without increasing arterial thrombosis in rabbits," Can J Anaesth 51:672-679 (2004).
Fernlund, P. and J. Stenflo, "Beta-hydroxyaspartic acid in vitamin K-dependent proteins," J. Biol. Chem. 258(20):12509-12512 (1983).
Forberg et al., "The impact of Glu102Lys on the factor X function in a patient with a doubly homozygous factor X deficiency (Gla14Lys and Glu102Lys)," Thromb. Haemost. 83:234-238 (2000).
Forsburg, S., "Codon usage table for *Schizosaccharomyces pombe*," Yeast, 10:1045-1047 (2004).
Foster et al., "The factor Xa-catalyzed activation of factor V," J. Biol. Chem., 258(22):13970-13977 (1983).

(56) References Cited

OTHER PUBLICATIONS

Friedler et al., "Development of a functional backbone cyclic mimetic of the HIV-1 Tat arginine-rich motif," J. Biol. Chem. 275:23783-23789 (2000).
Fung et al., "Characterization of an almost full-length cDNA coding for human blood coagulation factor X," PNAS U.S.A. 82:3591-3595(1985).
Furie, B. and B. Furie, "The molecular basis of blood coagulation," Cell, 53:505-518 (1988).
Gajdusek et al., "Activation of coagulation releases endothelial cell mitogens," J. Cell Biol. 103:419-428 (1986).
Gardner et al., "The complete nucleotide sequence of an infectious clone of cauliflower mosaic virus by M13mp7 shotgun sequencing," Nucleic Acids Res. 9(12):2871-2888 (1981).
Gasic et al., "Coagulation factors X, Xa, and protein S as potent mitogens of cultured aortic smooth muscle cells," Proc. Natl. Acad. Sci. USA. 89:2317-2320 (1992).
Gerhardt et al., "Report on a disease-adapted treatment in a patient with severe factor X deficiency resulting from a homozygous factor X gene mutation," Thromb Haemost. 99(1):238-239 (2008).
Gilbert, W. and L. Villa-Komaroff, "Useful proteins from recombinant bacteria," Sci. Am. 242:74-96 (1980).
Giles et al., "A combination of factor Xa and phosphatidylcholine-phosphatidylserine vesicles bypasses factor VIII in vivo," Br. J. Haematol. 69(4):491-497 (1988).
Giles et al., "Studies of Factors V and VIII:C in an animal model of disseminated intravascular coagulation," J. Clin. Invest. 74(6):2219-2225 (1984).
Girolami et al., "A "new" congenital haemorrhagic condition due to the presence of an abnormal factor X (factor X Friuli): study of a large kindred," Br J Haematol 19(2):179-192 (1970).
Girolami et al., "A new mutation (Arg251Trp) in the Ca2+ binding site of factor X protease domain appears to be responsible for the defect in the extrinsic pathway activation of factor X Padua," Clin Appl Thromb Hemost. 10(1):5-8 (2004).
Girolami et al., "Severe congenital factor X deficiency in 5-month-old child," Thromb Diath Haemorrh 24(1):175-184 (1970).
Gitel et al., "Inhibition of human activated Factor X by antithrombin III and alpha 1-proteinase inhibitor in human plasma," J. Biol. Chem. 259(11):6890-6895 (1984).
Greer, J., "Comparative modeling methods: Application to the family of mammalian serine proteases," Proteins: Structure, Function and Genetics 7:317-334 (1990).
Gribskov et al., "Sigma factors from E. coli, B. subtilis, phage SP01, and phage T4 are homologous proteins," Nucleic Acids Res. 14(16):6745-6763 (1986).
Grosschedl et al., "Introduction of a µ immunoglobulin gene into the mouse germ line: specific expression in lymphoid cells and synthesis of functional antibody," Cell 38:647-658 (1984).
Gruber et al., Blood (ASH Annual Meeting 2008 Abstracts) 112:Abstract 3825 (2008).
Hainmann et al., "Identification of a novel factor X deletion in combination with a missense mutation in the F10 gene—Genotype-phenotype correlation in a girl with severe factor X deficiency," Hamostaseologie. 29(2):184-186 (2009).
Hammer et al., "Diversity of alpha-fetoprotein gene expression in mice is generated by a combination of separate enhancer elements," Science 235:53-58 (1987).
Hanahan, D., "Heritable formation of pancreatic β-cell tumours in transgenic mice expressing recombinant insulin/simian virus 40 oncogenes," Nature 315:115-122 (1985).
Harr et al, "The acute coagulopathy of trauma is due to impaired initial thrombin generation but not clot formation or clot strength," J Surg Res 170(2):319-324 (2011).
Hedner et al., "Recombinant activated factor VII in the treatment of bleeding episodes in patients with inherited and acquired bleeding disorders," Transfusion Med Rev, 7:78-83 (1993).
Heeb et al., "Protein S binds to and inhibits factor Xa," Proc Natl Acad Sci U S A.91(7):2728-2732 (1994).
Herbert et al., "Effector protease receptor 1 mediates the mitogenic activity of factor Xa for vascular smooth muscle cells in vitro and in vivo," J. Clin. Invest. 101:993-1000 (1998).
Herrera-Estrella et al., "Expression of chimaeric genes transferred into plant cells using a ti-plasmid-derived vector," Nature 303:209-213 (1984).
Herrera-Estrella et al., "Light-inducible and chloroplast-associated expression of a chimaeric gene introduced into Nicotiana tabacum using a Ti plasmid vector," Nature 310:115-120 (1984).
Herrmann et al., "Factor X deficiency: clinical manifestation of 102 subjects from Europe and Latin America with mutations in the factor 10 gene," Haemophilia.12(5):479-489 (2006).
Herrmann et al., "Homozygous Factor X gene mutations Gly380Arg and Tyr163delAT are associated with perinatal intracranial hemorrhage," J Pediatr. 146(1):128-130 (2005).
Hicks et al., "Treatment of diffuse alveolar hemorrhage after allogeneic bone marrow transplant with recombinant factor VIIa," Bone Marrow Transpl. 30:975-978 (2002).
Himmelspach et al., "Recombinant human factor X: high yield expression and the role of furin in proteolytic maturation in vivo and in vitro," Thromb. Res., 97:51-67 (2000).
Hopfner et al., "Converting blood coagulation factor IXa into factor Xa: dramatic increase in amidolytic activity identifies important active site determinants," EMBO J. 16(22):6626-6635 (1997).
Iijima et al, "A dysfunctional factor X (factor X Kurayoshi) with a substitution of Arg 139 for Ser at the carboxyl-terminus of the light chain," Thromb Res 101:311-316 (2001).
Ingerslev et al., "Severe factor X deficiency in a pair of siblings: clinical presentation, phenotypic and genotypic features, prenatal diagnosis and treatment," Haemophilia 13:334-336 (2007).
Inoue, K. and T. Morita, "Identification of O-linked oligosaccharide chains in the activation peptides of blood coagulation factor X. The role of the carbohydrate moieties in the activation of factor X," Eur. J. Biochem, 218:153-163 (1993).
Isshiki et al., "Genetic analysis of hereditary factor X deficiency in a French patient of Sri Lankan ancestry: in vitro expression study identified Gly366Ser substitution as the molecular basis of the dysfunctional factor X," Blood Coagul. Fibrinolysis 16:9-16 (2005).
IUPAC-IUB Commission on Biochemical Nomenclature, "A one-letter notation for amino acid sequences: tentative rules," J. Biol. Chem. 243(13):3557-3559 (1968).
IUPAC-IUB Commission on Biochemical Nomenclature, "Symbols for amino-acid derivatives and peptides: recommendations (1971)," Biochem. 11(9):1726-1732 (1972).
Ivanciu et al., "A zymogen-like factor Xa variant corrects the coagulation defect in hemophilia," Nature Biotechnology, 29:1028-1033 (2011).
Izaguirre et al. "Mechanism by which exosites promote the inhibition of blood coagulation proteases by heparin-activated antithrombin," J. Biol. Chem. 282(46):33609-33622 (2007).
Izaguirre et al., "Engineering functional antithrombin exosites in alpha1-proteinase inhibitor that specifically promote the inhibition of factor Xa and factor IXa," J. Biol. Chem. 284(3):1550-1558 (2009).
Izaguirre et al., "Residues of Tyr253 and Glu255 in strand 3 of beta-sheet C of antithrombin are key determinants of an exosite made accessible by heparin activation to promote rapid inhibition of factors Xa and IXa," J. Biol. Chem. 281(19):13424-13432 (2006).
James et al., "Molecular defect in coagulation factor XFriuli results from a substitution of serine for proline at position 343," Blood 77:317-323 (1991).
Jameson et al., "Determination of the operational molarity of solutions of bovine alpha-chymotrypsin, trypsin, thrombin and factor Xa by spectrofluorimetric titration," Biochemical Journal, 131(1):107-117 (1973).
Jay et al., "Construction of a general vector for efficient expression of mammalian proteins in bacteria: use of a synthetic ribosome binding site," Proc. Natl. Acad. Sci. U.S.A. 78:5543-5548 (1981).
Jayandharan et al., "Six novel mutations including triple heterozygosity for Phe31Ser, 514delT and 516T—>G factor X gene mutations are responsible for congenital factor X deficiency in patients of Nepali and Indian origin," J Thromb Haemost. 3(7):1482-1487 (2005).

(56) References Cited

OTHER PUBLICATIONS

Johnson et al., "Antithrombin-S195A factor Xa-heparin structure reveals the allosteric mechanism of antithrombin activation," The EMBO Journal 25:2029-2037 (2006).
Karimi et al., "Phenotype and genotype report on homozygous and heterozygous patients with congenital factor X deficiency," Haematologica. 93(6):934-938 (2008).
Katre et al., "Chemical modification of recombinant interleukin 2 by polyethylene glycol increases its potency in the murine Meth A sarcoma model," Proc Natl Acad Sci U S A. 84(6):1487-1491 (1987).
Kaul et al., "Isolation and characterization of human blood-coagulation factor X cDNA," Gene 41:311-314 (1986).
Kelsey et al., "Species- and tissue-specific expression of human α1-antitrypsin in transgenic mice," Genes Dev. 1:161-171 (1987).
Ketner et al., "Efficient manipulation of the human adenovirus genome as an infectious yeast artificial chromosome clone," Proc. Natl. Acad. Sci. U.S.A. 91:6186-6190 (1994).
Khalilzadeh et al., "Process development for production of recombinant human interferon-γ expressed in *Escherichia coli*," J. Ind. Microbiol. Biotechnol. 31:63-69 (2004).
Kim et al., "Characterization of recombinant human coagultion factor XFriuli," Thromb Haemost. 75(2):313-317 (1996).
Kim et al., "Factor XKetchikan: a variant molecule in which Gly replaces a Gla residue at position 14 in the light chain," Hum. Genet. 95:212-214 (1995).
Kim et al., "Factors XWenatchee I and II: compound heterozygosity involving two variant proteins," Biochim Biophys Acta. 1271(2-3):327-334 (1995).
Kirchhofer et al., "The tissue factor region that interacts with substrates factor IX and factor X," Biochem. 39(25):7380-7387 (2000).
Knight et al., "Replacement therapy for congenital Factor X deficiency," Transfusion, 25(1):78-80 (1985).
Ko et al., "Coagulation factor Xa stimulates platelet-derived growth factor release and mitogenesis in cultured vascular smooth muscle cells of rat," J. Clin. Invest. 98:1493-1501 (1996).
Kollias et al., "Regulated expression of human Aγ-, β-, and hybrid γβ-globin genes in transgenic mice: manipulation of the developmental expression patterns," Cell 46:29-94 (1986).
Kopelman et al., "Cryohemostasis of uncontrolled hemorrhage from liver injury," Cryobiology 40:210-217 (2000).
Krishnaswamy et al., "Activation of human prothrombin by human prothrombinase. Influence of factor Va on the reaction mechanism," J. Biol. Chem., 262:3291-3299 (1987).
Krishnaswamy et al., "The prothrombinase-catalyzed activation of prothrombin proceeds through the intermediate meizothrombin in an ordered, sequential reaction," J. Biol. Chem. 261(19) 8977-8984 (1986).
Kruithof et al., "The effect of factor Xa/phospholipid infusion on the acute phase response in baboons," Thombosis and Haemostasis 77(2):308-311 (1997).
Krumlauf et al., "Developmental regulation of α-fetoprotein genes in transgenic mice," Mol. Cell. Biol. 5(7):1639-1648 (1985).
Langdown et al., "Allosteric activation of antithrombin critically depends upon hinge region extension," J. Biol. Chem., 279 (45): 47288-47297 (2004).
Larson et al., "Structure/function analyses of recombinant variants of human factor Xa: factor Xa incorporation into prothrombinase on the thrombin-activated platelet surface is not mimicked by synthetic phospholipid vesicles," Biochemistry. 37(14):5029-5038 (1998).
Leadley et al., "Non-hemostatic activity of coagulation factor Xa: potential implications for various diseases," Curr. Opin. Pharmacol. 1(2):169-175 (2001).
Lechler, E., "Use of prothrombin complex concentrates for prophylaxis and treatment of bleeding episodes in patients with hereditary deficiency of prothrombin, factor VII, factor X, protein C, protein S, or protein Z," Thromb Res. 95(Suppl. 1):S39-S50 (1999).
Leder et al., "Consequences of widespread deregulation of the c-myc gene in transgenic mice: multiple neoplasms and normal development," Cell 45:485-495 (1986).

Leytus et al., "Characterization of a cDNA coding for human factor X," PNAS U.S.A. 81:3699-3702 (1984).
Leytus et al., "Gene for human factor X: a blood coagulation factor whose gene organization is essentially identical with that of factor IX and protein C," Biochemistry. 25:5098-5102 (1986).
Lindenbaum et al., "A mammalian artificial chromosome engineering system (ACE System) applicable to biopharmaceutical protein production, transgenesis and gene-based cell therapy," Nucleic Acids Res. 32(21):e172 (2004).
MacDonald, R., "Expression of the pancreatic elastase I gene in transgenic mice," Hepatology 7(1):42S-51S (1987).
Macfarlane et al., "Proteinase-activated receptors," Pharmacol. Rev. 53(2):245-282 (2001).
Madison et al., "Converting tissue plasminogen activator to a zymogen: a regulatory triad of Asp-His-Ser," Science, 262:419-421 (1993).
Magram et al., "Developmental regulation of a cloned adult beta-globin gene in transgenic mice," Nature 315:338-340 (1985).
Manithody et al., "Role of basic residues of the autolysis loop in the catalytic function of factor Xa," Biochemistry 41:6780-6788 (2002).
Mann et al., "Prothrombin," Methods Enzymol., 80:286-302 (1981).
Mann et al., "Surface-dependent reactions of the vitamin K-dependent enzyme complexes," Blood 76(1):1-16 (1990).
Mannucci et al., "Recessively inherited coagulation disorders," Blood 104:1243-1252 (2004).
Marchetti et al., "Molecular bases of CRM+ factor X deficiency: a frequent mutation (Ser334Pro) in the catalytic domain and a substitution (Glu102Lys) in the second EGF-like domain." Br. J. Haematol. 90:910-915 (1995).
Margaritis et al., "Novel therapeutic approach for hemophilia using gene delivery of an engineered secreted activated factor VII," J. Clin. Invest. 113(7):1025-1031 (2004).
Martinowitz et al., "Intravenous rFVIIa administered for hemorrhage control in hypothermic coagulopathic swine with grade V liver injuries," J Trauma 50:721-729 (2001).
Mason et al., "The hypogonadal mouse: reproductive functions restored by gene therapy," Science 234:1372-1378 (1986).
Mathur et al., "Interaction of factor IXa with factor VIIIa. Effects of protease domain Ca2+ binding site, proteolysis in the autolysis loop, phospholipid, and factor X," J. Biol. Chem. 272(37):23418-23426 (1997).
Mayfield et al., "Expression and assembly of a fully active antibody in algae," Proc. Natl. Acad. Sci. U.S.A. 100(2):438-442 (2003).
Mayo Clinic, "Test ID: FXCH Coagulation Factor X Chromogenic Activity Assay, Plasma," Mayo Medical Laboratories Test Catalog Entry, [retrieved on Apr. 29, 2013] Retrieved from:<URL:mayomedicallaboratories.com/test-catalog/print. php?unit_code=89042, 4 pages.
McGee, M. and H. Rothberger, "Assembly of the prothrombin activator complex on rabbit alveolar macrophage high-affinity factor Xa receptors. A kinetic study," J Exp Med. 64(6):1902-1914 (1986).
McLean et al., "FXa-induced responses in vascular wall cells are PAR-mediated and inhibited by ZK-807834," Thombosis Research 103:281-297 (2001).
McMullen et al., "Complete amino acid sequence of the light chain of human blood coagulation factor X: evidence for identification of residue 63 as beta-hydroxyaspartic acid." Biochemistry 22:2875-2884 (1983).
Menegatti et al., "A rare inherited coagulation disorder: combined homozygous factor VII and factor X deficiency," Am. J. Hematol. 77(1):90-91 (2004).
Mertens, K. and R. Bertina, "Pathways in the activation of human coagulation factor X," Biochem. J. 185:647-658 (1980).
Messier et al., "Factor X Stockton: a mild bleeding diathesis associated with an active site mutation in factor X," Blood Coagul. Fibrinolysis 7:5-14 (1996).
Millar et al., "Molecular analysis of the genotype-phenotype relationship in factor X deficiency," Hum. Genet. 106:249-257 (2000).
Misenheimer et al., "The heparin-binding exosite is critical to allosteric activation of factor IXa in the intrinsic tenase complex: the role of arginine 165 and factor X," Biochem. 46(26):7886-7895 (2007).

(56) References Cited

OTHER PUBLICATIONS

Mitterlechner et al., "Prothrombin complex concentrate and recombinant prothrombin alone or in combination with recombinant factor X and FVIIa in dilutional coagulopathy: a porcine model," J Thrombosis and Haemostasis. 9(4):729-737 (2011).
Miyata et al., "Factor X Nagoya 1 and Nagoya 2: a CRM—factor X deficiency and a dysfunctional CRM+ factor X deficiency characterized by substitution of Arg306 by Cys and of Gly366 by Ser, respectively," Thromb Haemost. 79(3):486-490 (1998).
Miyata et al., "Factors X Nice I and II: two novel missense mutations (Met-40Val and Pro304Ser) in patient with coagulation factor X deficiency." Thromb Haemost. 80(4):709-710 (1998).
Moll, S. and D. Manley, "American Society of Hermatology (ASH) 2008 Special Report Podcast Transcript," Published on Dec. 31, 2008 [online][retrieved on Apr. 29, 2013] Retrieved from:<URL:stoptheclot.org/News/article145.htm, 2 pages.
Monnaie et al., "Identification of a binding site for quaternary amines in factor Xa," Biochemistry 39(18):5349-5354 (2000).
Monteiro, R., "Targeting exocites on blood coagulation proteases," Annals of the Brazilian Academy of Sciences 77:275-280 (2005).
Morishita et al., "One missense mutation in the factor X gene causing factor X deficiency—factor X Kanazawa," Int J Hematol. 73(3):390-392 (2001).
Morita, T. and C. Jackson, "Preparation and properties of derivatives of bovine factor X and factor Xa from which the gamma-carboxyglutamic acid containing domain has been removed," J. Biol. Chem. 261(9):4015-4023 (1986).
Mosnier, L. and J. Griffin, "Protein C anticoagulant activity in relation to anti-inflammatory and anti-apoptotic activities," Front. Biosci., 11:2381-2399 (2006).
Mota et al., "Molecular basis of factor X deficiency cases from India," Haemophilia. 16(4):686-709 (2010).
Muneta et al., "Large-scale production of porcine mature interleukin-18 (IL-18) in silkworms using a hybrid baculovirus expression system," J. Vet. Med. Sci. 65(2):219-223 (2003).
NCBI acc No. NP_000495.1:p.Ala152Thr; Reference SNP(refSNP) Cluster Report: rs3211772,[online][[retrieved on Jan. 5, 2012] Retrieved from:<URL:ncbi.nlm.nih.gov/SNP/snp_ref.cgi?type=rs&rs=3211772, 2 pages.
NCBI acc No. NP_000495.1:p.Arg366Cys; Reference SNP(refSNP) Cluster Report: rs104894392, [online][[retrieved on Jan. 5, 2012] Retrieved from:<URL:ncbi.nlm.nih.gov/SNP/snp_ref.cgi?searchType=adhoc_search&type=rs&rs=rs104894392, 2 pages.
NCBI acc No. NP_000495.1:p.Glu142Lys; Reference SNP(refSNP) Cluster Report: rs61753266,[online][[retrieved on Jan. 5, 2012] Retrieved from:<URL:ncbi.nlm.nih.gov/SNP/snp_ref.cgi?searchType=adhoc_search&type=rs&rs=rs6175326, 2 pages.
NCBI acc No. NP_000495.1:p.Gly104Asp; Reference SNP(refSNP) Cluster Report: rs112704590, [online][[retrieved on Jan. 5, 2012] Retrieved from:<URL:ncbi.nlm.nih.gov/nuccore/AF177422 [2 pages.].
NCBI acc No. NP_000495.1:p.Gly192Arg, Reference SNP(refSNP) Cluster Report: rs3211783, [online][[retrieved on Jan. 5, 2012] Retrieved from:<URL:ncbi.nlm.nih.gov/SNP/snp_ref.cgi?type=rs&rs=3211783, 2 pages.
Ndonwi et al, "Substitution of the Gla domain in factor X with that of protein C impairs its interaction with factor VIIa/tissue factor," J. Biol. Chem. 282(21):15632-15644 (2007).
Needleman, S. and C. Wunsch, "A general method applicable to the search for similarities in the amino acid sequence of two proteins," J. Mol. Biol. 48:443-453 (1970).
Nesheim et al., "The contribution of bovine Factor V and Factor Va to the activity of prothrombinase," J. Biol. Chem., 254:10952-10962 (1979).
Newmark, et al., "Preparation and properties of adducts of streptokinase and streptokinase-plas-min complex with polyethylene glycol and pluronic polyol F38," J. Appl. Biochem. 4:185-189 (1982).

Nicholson et al., "Effector cell protease receptor-1 is a vascular receptor for coagulation factor Xa," J. Biol. Chem. 271:28407-28413 (1996).
Nöbauer-Huhmann et al., "Factor X Frankfurt I: molecular and functional characterization of a hereditary factor X deficiency (Gla+25 to Lys)." Blood Coagul Fibrinolysis. 9(2):143-152 (1998).
Nogami et al., "Mechanisms of interactions of factor X and factor Xa with the acidic region in the factor VIII A1 domain," J Biol Chem. 279(32):33104-33113 (2004).
Odom et al.,"Five novel point mutations: two causing haemophilia B and three causing factor X deficiency," Mol Cell Probes 8:63-65 (1994).
Oldenburg et al., "Congenital deficiency of vitamin K dependent coagulation factors in two families presents as a genetic defect of the vitamin K-epoxide-reductase-complex," Thromb Haemost. 84:937-941 (2000).
Olesen et al., "Permissive hypotension and desmopressin enhance clot formation," J. Thrombosis and Haemostasis 7(S2):Abstract No. PP-MO-386, 1 page (2009).
Olson et al., "Accelerating ability of synthetic oligosaccharides on antithrombin inhibition of proteinases of the clotting and fibrinolytic systems," Thromb. Haemost. 92:929-939 (2004).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Padmanabhan et al., "Structure of human des(1-45) factor Xa at 2.2 Å resolution," J. Mol. Biol. 232:947-966 (1993).
Papapetropoulos et al., "Hypotension and inflammatory cytokine gene expression triggered by factor Xa-nitric oxide signaling," Proc. Natl. Acad. Sci. USA 95:4738-4742 (1998).
Pearson et al., "Improved tools for biological sequence comparison," Proc. Natl. Acad. Sci. U.S.A. 85:2444-2448 (1988).
Perry, D., "Factor X and its deficiency states," Haemophilia 3:159-172 (1997).
Persson, E., "Protein disulfide isomerase has no stimulatory chaperone effect on factor X activation by factor VIIa-soluble tissue factor," Thromb Res. 123(1):171-176 (2008).
Petersen et al., "Zymogen-activation kinetics. Modulatory effects of trans-4-(aminomethyl)cyclohexane-1-carboxylic acid and poly-D-lysine on plasminogen activation," Biochem. J. 225(1):149-158 (1985).
Peyvandi et al., "Congenital factor X deficiency: spectrum of bleeding symptoms in 32 Iranian patients," Br J Haematol. 102:626-628 (1998).
Peyvandi et al., "Gene mutations and three-dimensional structural analysis in 13 families with severe factor X deficiency," Br J Haematol. 117(3):685-692. (2002).
Pham et al., "Large-scale transient transfection of serum-free suspension-growing HEK293 EBNA1 cells: peptone additives improve cell growth and transfection efficiency," Biotechnol. Bioeng. 84:332-342 (2003).
Pinotti et al., "Impaired prothrombinase activity of factor X Gly381Asp results in severe familial CRM+ FX deficiency," Thromb Haemost. 89(2):243-248 (2003).
Pinotti et al., "Molecular characterization of factor X deficiency associated with borderline plasma factor X level," Haematologica. 89(4):501-502 (2004).
Pinotti et al., "Reduced activation of the Gla19Ala FX variant via the extrinsic coagulation pathway results in symptomatic CRMred FX deficiency," Thromb Haemost. 88(2):236-241 (2002).
Platis, D. and G. Foster, "High yield expression, refolding, and characterization of recombinant interferon α2/α8 hybrids in *Escherichia coli*," Protein Exp. Purif. 31(2):222-230 (2003).
Pryzdial, E. and G. Kessler, "Kinetics of blood coagulation factor Xaalpha autoproteolytic conversion to factor Xabeta. Effect on inhibition by antithrombin, prothrombinase assembly, and enzyme activity," J. Biol. Chem. 271:16621-16626 (1996).
Quinsey et al., "Molecular determinants of the mechanism underlying acceleration of the interaction between antithrombin and factor Xa by heparin pentasaccharide," J. Biol. Chem., 277:15971-15978 (2002).

(56) References Cited

OTHER PUBLICATIONS

Qureshi et al., "FRET studies with factor X mutants provide insight into the topography of the membrane-bound factor X/Xa," Biochem J. 407(3):427-433 (2007).
Racchi et al., "Human coagulation factor X deficiency caused bya mutant signal peptide that blocks cleavage by signal peptidase but not targeting and translocation to the Endoplasmic Reticulum," J Biol. Chem. 268(8)5753-5740 (1993).
Rai et al., "Perspectives on factor Xa inhibition," Curr. Med. Chem. 8(2):101-119 (2001).
Readhead et al., "Expression of a myelin basic protein gene in transgenic shiverer mice: correction of the dysmyelinating phenotype," Cell 48:703-712 (1987).
Reddy et al., "Molecular characterization of human factor XSan Antonio," Blood 74:1486-1490 (1989).
Rezaie et al., "Asp-70—>Lys mutant of factor X lacks high affinity Ca2+ binding site yet retains function," J Biol Chem. 269(34):21495-21499 (1994).
Rezaie et al., "Contribution of residue 192 in factor Xa to enzyme specificity and function," J Biol Chem. 270(27):16176-16181 (1995).
Rezaie et al., "Identification of factor Xa residues critical for interaction with protein Z-dependent protease inhibitor: both active site and exosite interactions are required for inhibition," J. Biol. Chem., 280:32722-32728 (2005).
Rezaie et al., "Sodium binding site of factor Xa: role of sodium in the prothrombinase complex," Biochemistry 39:1817-1825 (2000).
Rezaie, A., "Identification of basic residues in the heparin-binding exosite of factor Xa critical for heparin and factor Va binding," J. Biol. Chem., 275(5):3320-3327 (2000).
Rezaie, A., "Role of residue 99 at the S2 subsite of factor Xa and activated protein C in enzyme specificity," J. Biol. Chem. 271(39):23807-23814 (1996).
Richmond, T., "Precompiled codon-usage tables," Genome Biology 1:reports241, 1 page.(2000).
Roberts, H. and M. Bingham, "Other coagulation factor deficiencies," found in: *Thrombosis and Hemorrhage*, 2nd ed. Baltimore, MD: Williams & Wilkins, pp. 773-802 (1998).
Roberts et al., "Survival of transfused Factor X in patients with Stuart Disease," Thromb Diath Haemorrh. 13:305-313 (1965).
Roberts et al., "Hemophilia A and hemophilia B," found in: *Hematology*, Lichtman et al., eds., 7th ed., New York: McGraw-Hill, pp. 1867-1886 (2006).
Rudolph et al., "Definition of a factor Va binding site in factor Xa," J. Biol. Chem., 276:5123-5128 (2001).
Rudolph et al., "Expression, purification, and characterization of recombinant human factor X," Prot. Express and Puri., 10:373-378 (1997).
Rudolph et al., "Factor XSt. Louis II. Identification of a glycine substitution at residue 7 and characterization of the recombinant protein," J. Biol. Chem. 271:28601-28606 (1996).
Rudolph et al., "The role of the factor X activation peptide: a deletion mutagenesis approach," Thromb Haemost., 88:756-762 (2002).
Salemink et al., "Inhibition of tissue factor-factor VIIa-catalyzed factor X activation by factor Xa-tissue factor pathway inhibitor," J. Biol. Chem. 274(40):28225-28232 (1999).
Schwartz, R. and M. Dayhoff, "Matrices for detecting distant relationships," found in: *Atlas of Protein Seugence and Structure*, National Biomedical Research Foundation, pp. 353-358 (1979).
Segers et al., "Coagulation factor V and thrombophilia: background and mechanisms," Thromb. Haemost., 98:530-542 (2007).
Selander-Sunnerhagen et al., "How an epidermal growth factor (EGF)-like domain binds calcium. High resolution NMR structure of the calcium form of the NH2-terminal EGF-like domain in coagulation factor X," J. Biol. Chem. 267(27):19642-19649 (1992).
Senden et al., "Factor Xa induces cytokine production and expression of adhesion molecules by human umbilical vein endothelial cells," J. Immunol 161:4318-4324 (1998).
Seymour et al., "Ecotin is a potent anticoagulant and reversible tight-binding inhibitor of factor Xa," Biochemistry 33:3949-3958 (1994).

Shani, M., "Tissue-specific expression of rat myosin light-chain 2 gene in transgenic mice," Nature 314:283-286 (1985).
Sharp et al., "Codon usage patterns in *Escherichia coli, Bacillus subtilis, Saccharomyces cerevisiae, Schizosaccharomyces pombe, Drosophila melanogaster and Homo sapiens*; a review of the considerable within-species diversity," Nucleic Acids Res., 12:8207-821 1 (1988).
Sharp, P. and E. Cowe, "Synonymous codon usage in *Saccharomyces cerevisiae*," Yeast 7:657-678 (1991).
Shen et al., "A novel mutation with Ins C (882-883) of the factor X gene in a Taiwanese Chinese factor X-deficient family," Thromb Haemost., 91(1):208-209 (2004).
Shikata et al., "Association of pharmacokinetic (CYP2C9) and pharmacodynamic (factors II, VII, IX, and X; proteins S and C; and γ-glutamyl carboxylase) gene variants with warfarin sensitivity," Haemost. Thromb. Vasc. Biol. 103(7):2630-2635 (2004).
Shirahata et al., "Clinical pharmacological study of a plasma-derived factor VIIa and factor X mixture (MC710) in haemophilia patients with inhibitors—phase I trial," Haemophilia 18:94-101 (2012).
Simioni et al., "A dysfunctional factor X (factor X San Giovanni Rotondo) present at homozygous and double heterozygous level: identification of a novel microdeletion (delC556) and missense mutation (Lys(408)—>Asn) in the factor X gene. A study of an Italian family," Thromb. Res. 101:219-230 (2001).
Sinha et al., "Expression, purification, and characterization of inactive human coagulation factor Xa (Asn322Ala419)," Protein Expr Purif. 3(6):518-524 (1992).
Skogen et al., "Comparison of coagulation factor Xa and des-(1-44)factor Xa in the assembly of prothrombinase," J. Biol. Chem. 259(4):2306-2310 (1983).
Skoko et al., "Expression and characterization of human interferon-β1 in the methylotrophic yeast *Pichia pastoris*," Biotechnol. Appl. Biochem. 38:257-265 (2003).
Smith, T. and M. Waterman, "Comparison of biosequences," Adv. Appl. Math. 2:482-489 (1981).
Sondeen et al., "Recombinant factor VIIa increases the pressure at which rebleeding occurs in porcine uncontrolled aortic hemorrhage model," Shock 22:163-168 (2004).
Srour et al., "Regulation of human factor IX expression using doxycycline-inducible gene expression system," Thromb. Haemost. 90:398-405 (2003).
Stanley et al., "The propeptides of the vitamin K-dependent proteins possess different affinities for the vitamin K-dependent carboxylase," J Biol. Chem. 274(24):16940-16944 (1999).
Stanton, C. and R. Wallin, "Processing and trafficking of clotting factor X in the secretory pathway. Effects of warfarin," Biochem. J. 284:25-31 (1992).
Sun et al., "Vitamin K epoxide reductase significantly improves carboxylation in a cell line overexpressing factor X," Blood, 106:3811-3815 (2005).
Sunnerhagen et al., "The effect of aspartate hydroxylation on calcium binding to epidermal growth factor-like modules in coagulation factors IX and X," J. Biol. Chem. 268(31):23339-23341 (1993).
Swift et al., "Tissue-specific expression of the rat pancreatic elastase I gene in transgenic mice,"Cell 38:639-646 (1984).
Takeya et al., "Coagulation factor X activating enzyme from Russell's viper venom (RVV-X). A novel metalloproteinase with disintegrin (platelet aggregation inhibitor)-like and C-type lectin-like domains," J Biol. Chem., 267:14109-14117 (1992).
Tanaka et al., "Blood coagulation: hemostasis and thrombin regulation," Anesth. Analg. 108:1433-1446 (2009).
The National Institute for Biological Standards and Control 6th British Working Standard for Blood Coagulation Factors II, IX, X Concentrate, Published Jun. 19, 2009, 2 pages.
Thiec et al., "Role of the Gla and first epidermal growth factor-like domains of factor X in the prothrombinase and tissue factor-factor VIIa complexes," JBC, 12:10393-10399 (2003).
Thompson et al., "Contractile properties of bovine α-thiombin and meitzothrombin in rabbit femoral arteries," Blood, 70:410a, Abstract 1494 (1987).
Thompson et al., "Sensitivity of rabbit arteries to meizothrombin is greater than that to α-thrombin," J. Vasc. Med. Biol., 1:347-353 (1990).

(56) References Cited

OTHER PUBLICATIONS

Todd et al., "Severe factor X deficiency due to a homozygous mutation (Cys364Arg) that disrupts a disulphide bond in the catalytic domain," Haemophilia 12:621-624 (2006).

Toso et al., "The conformational switch from the factor X zymogen to protease state mediates exosite expression and prothrombinase assembly," J. Biol. Chem., 283:18627-18635 (2008).

Tracy et al., "Coordinate binding of factor Va and factor Xa to the unstimulated platelet," J Biol Chem. 256(2):743-751 (1981).

Tranholm et al., "Improved hemostasis with superactive analogs of factor VIIa in a mouse model of hemophilia A," Blood 102(10):3615-3620 (2003).

Tranholm et al., "Recombinant factor VIIa reduces bleeding in severely thrombocytopenic rabbits." Thromb. Res. 109:217-223 (2003).

Uprichard, J. and D. Perry, "Factor X deficiency." Blood Reviews. 16:97-110 (2002).

Venkateswarlu et al., "Structure and dynamics of zymogen human blood coagulation factor X." Biophys J 82(3):1190-1206 (2002).

Vianello et al., "A new factor X defect (factor X Padua 3): a compound heterozygous between true deficiency (Gly(380)—>Arg) and an abnormality (Ser(334)—>Pro)." Thromb. Res. 104:257-264 (2001).

Vianello et al., "A novel type I factor X variant (factor X Cys350Phe) due to loss of a disulfide bond in the catalytic domain." Blood Coagul. Fibrinolysis 14:401-405 (2003).

Vianello et al., "Conformation sensitive gel electrophoresis for detection of factor X gene mutations." Thromb. Res. 107:51-54 (2002).

Volkel et al., "Engineering of human coagulation factor x variants activated by prostate-specific antigen." Mol. Biotechnol., 29 (1):19-30 (2005).

Wagner et al., "Nucleotide sequence of the thymidine kinase gene of herpes simplex virus type I," Proc. Natl. Acad. Sci. U.S.A. 78:1441-1445 (1981).

Wallmark et al., "Molecular defect (Gla26—>Asp) and its functional consequences in a hereditary Factor X Deficiency (Factor X "Malmo 4")." Blood 78 (Suppl1): 60a (1991).

Wallmark et al., "Molecular defect in F. X. "Ockero," a mild congenital F. X. deficiency." Thromb Haemost. 65:1263 (1991).

Wang et al., "[Inherited coagulation factor X deficiency caused by two novel mutations in factor X gene]." Zhonghua Xue Ye Xue Za Zhi. 25(9):519-522 (2004) [article in Chinese, abstract in English].

Wang et al., "Factor X Shanghai and disruption of translocation to the endoplasmic reticulum." Haematologica. 90(12):1659-1664 (2005).

Wang et al., "Molecular characterization of two novel mutations causing factor X deficiency in a Chinese pedigree." Haemophilia. 11(1):31-37 (2005).

Watson et al., "Molecular Biology of the Gene," 4th Edition, The Benjamin/Cummings Publ. Co., p. 224 (1987).

Watzke et al., "Factor XSanto Domingo. Evidence that the severe clinical phenotype arises from a mutation blocking secretion." J Clin Invest. 88(5):1685-1689 (1991).

Watzke et al., "Molecular analysis and in vitro expression of a hereditary CRM-negative factor X variant: FX Vienna," Blood 80(suppl 1):365a (1992).

Watzke et al., "Molecular defect (Gla+14—Lys) and its functional consequences in a hereditary factor X deficiency (factor X "Vorarlberg")." J. Biol. Chem. 265:11982-11989 (1990).

Weiner et al., "Liposome-collagen gel matrix: a novel sustained drug delivery system," J. Pharm. Sci. 74(9):922-925 (1985).

Whinna et al., "Role of the gamma-carboxyglutamic acid domain of activated factor X in the presence of calcium during inhibition by antithrombin-heparin."J. Thromb Haemost 2(7):1127-1134 (2004).

Wolf et al., "Design of constructs for the expression of biologically active recombinant human factors X and Xa. Kinetic analysis of the expressed proteins." J. Biol. Chem. JBC. 266 (21):13726-13730 (1991).

Wolf et al., "Procoagulant activity of reversibly acylated human factor Xa." Blood. 86:4153-4157 (1995).

Yamamoto et al., "Identification of a functional promoter in the long terminal repeat of rous sarcoma virus," Cell 22:787-797 (1980).

Yang et al., "Factor Va alters the conformation of the Na+-binding loop of factor Xa in the prothrombinase complex." Biochemistry 47(22):5976-5985 (2008).

Yang et al., "Functional role of O-linked and N-linked glycosylation sites present on the activation peptide of factor X." J. Thromb. Haemost., 7(10):1696-1702 (2009).

Yang et al., "The role of autolysis loop in determining the specificity of coagulation proteases." Braz J Med Biol Res. 40(8):1055-1064 (2007).

Zama et al., "A family with hereditary factor X deficiency with a point mutation Gla32 to Gln in the Gla domain (factor X Tokyo)." Br. J. Haematol. 106:809-811 (1999).

Zhong et al., "The N-terminal epidermal growth factor-like domain in factor IX and factor X represents an important recognition motif for binding to tissue factor," J. Biol. Chem. 277(5):3622-3631 (2002).

Letter/Written Disclosure of the Information Statement for the above-referenced application, mailed on Sep. 23, 2012, 2 pages.

Bereczky et al., "Severe inherited factor X deficiency caused by a novel point mutation." Abstract: P1124, Supplement to the Journal of Thrombosis and Haemostasis, Jul. 2001, 1 page.

Camire et al., "Identification and characterization of mutations leading to factor X deficiency". Abstract: OC1030, Supplement to the journal Thrombosis and Haemostatis, Jul. 2001, 1 page.

Herrmann et al., "Two novel factor X gene mutations in severe factor X deficiency—Greifswald register of factor X deficiency." Abstract: P1126, Supplement to the Journal of Thrombosis and Haemostasis, Jul. 2001, 1 page.

Morishita et al., "Molecular genetic analysis of factor X deficiency (factor X Ohmura): identification of a novel gene alteration in Japanese family." Abstract: CD3372, Supplement to the Journal of Thrombosis and Haemostasis, Jul. 2001, 1 page.

Letter/Written Disclosure of Supplemental Information Disclosure Statement for the above-referenced application, filed herewith on Mar. 27, 2015, 2 pages.

Friedrich et al., "Staphylocoagulase is a prototype for the mechanism of cofactor-induced zymogen activation," Nature 425:535-539 (2003).

Written Opinion, mailed Nov. 14, 2014, in connection with International Patent Application No. PCT/US2013/032616, 7 pages.

Response, filed Jan. 14, 2015, to Written Opinion, mailed Nov. 14, 2014, in connection with International Patent Application No. PCT/US2013/032616, 50 pages.

International Preliminary Report on Patentability, mailed Feb. 6, 2015, in connection with International Patent Application No. PCT/US2013/032616, 62 pages.

\* cited by examiner

FIGURE 3A

```
human   ANSFLEEMKKGHLERECMEETCSYEEAREVFEDSDKTNEFWNKYKDGDQCETSPCQNQGK
Gibbon  ANSFLEEMKKGNLERECMEETCSYEEAREVFEDSDKTNEFWNKYKDGDQCETSPCQNEGK
        ***********:***********************************************:**

human   CKDGLGEYTCTCLEGFEGKNCELFTRKLCSLDNGDCDQFCHEEQNSVVCSCARGYTLADN
Gibbon  CKDGLGEYTCTCLEGFEGKNCELFTRKLCSLDNGDCDQFCHEEQNSVVCSCARGYTLADN
        ************************************************************ human   GKACIPTGPYPCGKQTLERRKRSVAQATSSSGEAPDSITWKPYDAADLDPTENPFDLLDF
Gibbon  GKACIPTGPYPCGKQTLERRKRSVAQATNSSGEGPDSITWKPYDAADLDPTENPFDLLDF
        **************************.*.************************** human   NQTQPERGDNNLTRIVGGQECKDGECPWQALLINEENEGFCGGTILSEFYILTAAHCLYQ
Gibbon  NQTQPETGDNNLVRIVGGRECKDGECPWQALLINEENEGFCGGTILSEFYILTAAHCLYQ
        ****.*..**************************************** human   AKRFKVRVGDRNTEQEEGGEAVHEVEVVIKHNRFTKETYDFDIAVLRLKTPITFRMNVAP
Gibbon  AKRFKVRVGDRNTEQEEGGEAVHEVEVVIKHNRFTKETYDFDIAVLRLKTPITFRMNVAP
        ************************************************************ human   ACLPERDWAESTLMTQKTGIVSGFGRTHEKGRQSTRLKMLEVPYVDRNSCKLSSSFIITQ
Gibbon  ACLPERDWAESTLMTQKTGIVSGFGRTHEKGRQSTRLKMLEVPYVDRNSCKLSSSFIITQ
        ************************************************************ human   NMFCAGYDTKQEDACQGDSGGPHVTRFKDTYFVTGIVSWGEGCARKGKYGIYTKVTAFLK
Gibbon  NMFCAGYHARQEDACQGDSGGPHVTRFKDTYFVTGIVSWGEGCARKGKYGIYTKVTAFLK
        *****.:****************************************************** human   WIDRSMKTRGLPKAKSHAPEVITSSPLK
Gibbon  WIDRSMKTRGLPKAESHAPEVITPSPLK
        **************:.*******.****
```

FIGURE 3B

```
human        ANSFLEEMKKGHLERECMEETCSYEEAREVFEDSDKTNEFWNKYKDGDQCETSPCQNQGK
OliveBaboon  SNSFLEELKKGNLERECMEETCSYEEAREVFEDIDKTNEFWNKYKDGDQCETSPCQNEGK
             :.***:*:**************** ***********************:* human        CKDGLGEYTCTCLEGFEGKNCELFTRKLCSLDNGDCDQFCHEEQNSVVCSCARGYTLADN
OliveBaboon  CRDGLGEYTCTCLEGFEGKNCELFTRKLCSLDNGDCDQFCHEEQNSVVCSCARGYTLADN
             *:********************************************************** human        GKACIPTGPYPCGKQTLERRKRSVAQATSSSGEAPDSITWKPYDAADLDPTENPFDLLDF
OliveBaboon  GKACIPTGPYPCGKQTLERRKRSAAQATNSSGEASDSIIWKPDDAADLDATENPFDLLDF
             *********************:.*.* .***:******** human        NQTQPERGDNNLTRIVGGQECKDGECPWQALLINEENEGFCGGTILSEFYILTAAHCLYQ
OliveBaboon  NQTQPERGDNNLIRIVGGRECENGECPWQALLINEENEGFCGGTILSEFYILTAAHCLYQ
             ********** *: :.********************************** human        AKRFKVRVGDRNTEQEEGGEAVHEVEVVIKHNRFTKETYDFDIAVLRLKTPITFRMNVAP
OliveBaboon  AKRFKVRVGDRDMEQEEGGEAVHEVEVIIKHNRFTKETYDFDIAVLRLKSPITFRMNVAP
             *********: .*********:****************:********* human        ACLPERDWAESTLMTQKTGIVSGFGRTHEKGRQSTRLKMLEVPYVDRNSCKLSSSFIITQ
OliveBaboon  ACLPERDWAESTLMTQKTGIVSGFGRTHEKGRQSTRLKMLEVPYVDRNSCKLSSSFIITQ
             ************************************************************ human        NMFCAGYDTKQEDACQGDSGGPHVTRFKDTYFVTGIVSWGEGCARKGKYGIYTKVTAFLK
OliveBaboon  NMFCAGYHAKQEDACQGDSGGPHVTRFKDTYFVTGIVSWGEGCARKGKYGIYTKVTAFLK
             *****  :**************************************** human        WIDRSMKTRGLPKAKSHAPEVITSSPLK
OliveBaboon  WIDRSMKTRGLPKAESRAPEVSTSSPLK
             **************:*:.*****:*****
```

FIGURE 3C

```
human        ANSFLEEMKKGHLERECMEETCSYEEAREVFEDSDKTNEFWNKYKDGDQCETSPCQNQGK
RhesusMonkey SNSFLEEMKKGNLERECMEETCSYEEAREVLEDSDKTNEFWNKYKDGDQCETSPCQNEGK
             :.*********:****************:*********************** human        CKDGLGEYTCTCLEGFEGKNCELFTRKLCSLDNGDCDQFCHEEQNSVVCSCARGYTLADN
RhesusMonkey CRDGLGEYTCTCLEGFEGKNCELFTRKLCSLDNGECDQFCHEEQNSVVCSCARGYTLADN
             *.******************************:*********************** human        GKACIPTGPYPCGKQTLERRKRSVAQATSSSGEAPDSITWKPYDAADLDPTENPFDLLDF
RhesusMonkey GKACIPTGPYPCGKQTLERRKRSAAQATNSSGEAPDNIIWKPDDAADLDATENPFDLLDF
             *********************..***:....*.******* human        NQTQPERGDNNLTRIVGGQECKDGECPWQALLINEENEGFCGGTILSEFYILTAAHCLYQ
RhesusMonkey NQTQPERGDNNLIRIVGGRECENGECPWQALLINEENEGFCGGTILSEFYILTAAHCLYQ
             **********.*:.*:******************************** human        AKRFKVRVGDRNTEQEEGGEAVHEVEVVIKHNRFTKETYDFDIAVLRLKTPITFRMNVAP
RhesusMonkey AKRFKVRVGDRDMEQEEGGEAVHEVEVVIKHNRFTKETYDFDIAVLRLKSPITFRMNVAP
             *********: *******************************:********* human        ACLPERDWAESTLMTQKTGIVSGFGRTHEKGRQSTRLKMLEVPYVDRNSCKLSSSFIITQ
RhesusMonkey ACLPERDWAESTLMTQKTGIVSGFGRTHEKGRQSTRLKMLEVPYVDRNSCKLSSSFIITQ
             ************************************************************ human        NMFCAGYDTKQEDACQGDSGGPHVTRFKDTYFVTGIVSWGEGCARKGKYGIYTKVTAFLK
RhesusMonkey NMFCAGYHAKQEDACQGDSGGPHVTRFKDTYFVTGIVSWGEGCARKGKYGIYTKVTAFLK
             *****.:************************************************ human        WIDRSMKTRGLPKAKSHAPEVITSSPLK
RhesusMonkey WIDRSMKTRGLPKAESRAPEASTSSPLK
             **************:*.****:.*****
```

FIGURE 3D human           ANSFLEEMKKGHLERECMEETCSYEEAREVFEDSDKTNEFWNKYKDGDQCETSPCQNQGK
DuskyTitiMonkey ANSILEELKKGNLERECMEETCSYEEAREVFEDSDQTNEFWNKYKDGDQCESDPCQNQGK
                *:**:*.*****************.*************:..***** human           CKDGLGEYTCTCLEGFEGKNCELFTRKLCSLDNGDCDQFCHEEQNSVVCSCARGYTLADN
DuskyTitiMonkey CKDGLGQYTCTCLEGFEGKNCELFTRKLCSLDNGDCDQFCHEEQNSVVCSCASGYVLADD
                ****:***********************************  .:. :

human           GKACIPTGPYPCGKQTLERRKRSVAQATSSSGEAPDSITWKPYDAADLDPTENPFDLLDF
DuskyTitiMonkey GKACIPTGPYPCGKLTLERRKRAAAQATHRRGETPGTITRPQHNTSDPDPTENPFDLLGF
                ************ ***:.. * ***.* : :: *********.* human           NQTQPERGDNNLTRIVGGQECKDGECPWQALLINEENEGFCGGTILSEFYILTAAHCLYQ
DuskyTitiMonkey NQTQPEWEESDLVRIVGGRDCKDGECPWQALLINEENEGFCGGTILSEFHVLTAAHCLHQ
                ******  :.:*.***::***********************:.*****:* human           AKRFKVRVGDRNTEQEEGGEAVHEVEVVIKHNRFTKETYDFDIAVLRLKTPITFRMNVAP
DuskyTitiMonkey AKRFKVRVGDRNTEKEEGETVHEVEVIIKHNRFSIETYDFDITVLRLKTPITFRMNVAP
                ************:.**:**: *** ************ human           ACLPERDWAESTLMTQKTGIVSGFGRTHEKGRQSTRLKMLEVPYVDRNSCKLSSSFIITQ
DuskyTitiMonkey ACLPARDWAESTLMTQKTGIVSGFGRTHEKGRQSTTLKILEVPYVDRNTCKLSSSFTITQ
                **.**************************.:******.** * human           NMFCAGYDTKQEDACQGDSGGPHVTRFKDTYFVTGIVSWGEGCARKGKYGIYTKVTAFLK
DuskyTitiMonkey NMFCAGYEARQEDACQGDSGGPHVTRFKDTYFVTGIVSWGEGCARKGKYGIYTKVSGFLK
                *****:::*********************************** .* human           WIDRSMKTRGLPKAKSHAPEVITSSPLK
DuskyTitiMonkey WIDRSMKTRGVPKAESHVPGVNTSSPLK
                ********:*:***.*.******

FIGURE 3E

```
human            ANSFLEEMKKGHLERECMEETCSYEEAREVFEDSDKTNEFWNKYKDGDQCETSPCQNQGK
AfricanElephant  ANSFLEEMKQGNLERECMEETCSFEEAREVFEDDVKTNEFWNRYKDGDQCESNPCQNQGK
                 ***********:*:**********:**.:********:.:******* human            CKDGLGEYTCTCLEGFEGKNCELFTRKLCSLDNGDCDQFCHEEQNSVVCSCARGYTLADN
AfricanElephant  CQDGLGEYTCTCLEGFEGKNCELTIRELCSLDNGDCDQFCNEERNSVVCSCAAGYTLGDN
                 *:********************: *:*************:**:********:****.**

human            GKACIPTGPYPCGKQTLERRKRSVAQATSSSGEAPDSITWKPYDAADLDPTENPFDLLDF
AfricanElephant  GKSCISTEPFPCGKLTMGRNKRSLAQANNVSGSPPETSTQKQYGLDDLAPTENPVNLLNL
                 **:**. *.:****  * *:***:****..:.* *.  :::   * .*  ***** :**: :

human            NQTQPERGDNNLTRIVGGQECKDGECPWQAALLINEENEGFCGGTILSEFYILTAAHCLYQ
AfricanElephant  NQEFPEQDTSDLVRIVGGRDCKEGECPWQALLVNEENEGFCGGTILNEYYILTAAHCLHQ
                 ** : *: *::* ***:::******* *::**********::*:*********:* human            AKRFKVRVGDRNTEQEEGGEAVHEVEVVIKHNRFTKETYDFDIAVLRLKTPITFRMNVAP
AfricanElephant  AKRFKVRVGDRNTEKEEGNEMAHEVEIILKHNKFVRETYDFDIAVIKLKTPITFRMNVAP
                 ************:*.*.*****::*:***:*.******::********** human            ACLPERDWAESTLMTQKTGIVSGFGRTHEKGRQSTRLKMLEVPYVDRNSCKLSSSFIITQ
AfricanElephant  ACLPEKDWAESTLMTQKTGIVSGFGRTHEKGRASTILKMLEVPYVDRNTCKLSSSFTITQ
                 ***:**********************::*********:** * human            NMFCAGYDTKQEDACQGDSGGPHVTRFKDTYFVTGIVSWGEGCARKGKYGIYTKVTAFLK
AfricanElephant  NMFCAGYDSKPEDACQGDSGGPHVTRFKDTYFVTGIVSWGEGCARKGKYGVYTKVTSFLK
                 ********:* ***********************************:*:* human            WIDRSMKTRGLPKAKSHAPEVITSSPLK
AfricanElephant  WIDRCMKTKAGVHAQAP-----------
                 ****.***.. : *. *
```

FIGURE 3F

```
human   ANSFLEEMKKGHLERECMEETCSYEEAREVFEDSDKTNEFWNKYKDGDQCETSPCQNQGK
Mouse   ANSFFEEFKKGNLERECMEEICSYEBVREIFEDDEKTKEYWTKYKDGDQCESSPCQNQGA
        *::*:::***   ****:.:.*:.:.*:.**:**;**** human   CKDGLGEYTCTCLEGFEGKNCELFTRKLCSLDNGDCDQFCHEEQNSVVCSCARGYTLADN
Mouse   CRDGIGGYTCTCSEGFEGKNCELFVRKLCRLDNGDCDQFCREEQNSVVCSCASGYFLGND
        *:**:*  *****  ***********.****  ***********:**********.**:* ..:

human   GKACIPTGPYPCGKQTLERRKRSVAQATSSSGEAPDSITWKPYDAADLDPTENPFDLLDF
Mouse   GKSCISTAPFPCGKITTGRRKRSVALNTSDS---ELDLEDALLDEDFLSPTENPIELLNL
        **:**.:.*:****  * *:*****  .**..   *  *   :* ***** :**:

human   NQTQPERGDNNLTRIVGGQECKDGECPWQALLINEENEGFCGGTILSEFYILTAAHCLYQ
Mouse   NETQPERSSDDLVRIVGGRECKDGECPWQALLINEDNEGFCGGTILNEFYILTAAHCLHQ
        *:*****..*::.***.************:*****:*********:* human   AKRFKVRVGDRNTEQEEGGEAVHEVEVVIKHNRFTKETYDFDIAVLRLKTPITFRMNVAP
Mouse   ARRFKVRVGDRNTEKEEGNEMVHEVDVVIKHNKFQRDTYDYDIAVLRLKTPITFRMNVAP
        * **********:*.* **:****:*  :* *************** human   ACLPERDWAESTLMTQKTGIVSGFGRTHEKGRQSTRLKMLEVPYVDRNSCKLSSSFIITQ
Mouse   ACLPQKDWAESTLMTQKTGIVSGFGRTHEKGRQSNILKMLEVPYVDRNTCKLSTSFSITQ
        **::********************  :.****:*  **:  :*:* human   NMFCAGYDTKQEDACQGDSGGPHVTRFKDTYFVTGIVSWGEGCARKGKYGIYTKVTAFLK
Mouse   NMFCAGYEAKLEDACQGDSGGPHVTRFKNTYYVTGIVSWGEGCARKGKYGIYTKVTTFLK
        *******::* **************::*******************.* human   WIDRSMKTRGLPKAKSHAPEVITSSPLK
Mouse   WIDRSMKARVGPTAETPRTAGPPN----
        *******  *..* *.*:: .
```

FIGURE 3G

```
human   ANSFLEEMKKGHLERECMEETCSYEEAREVFEDSDKTNEFWNKYKDGDQCETSPCQNQGK
rabbit  ANSFLEELKKGNLERECMEENCSYEEALEVFEDREKTNEFWNKYVDGDQCESNPCQNQGT
        ****:*.*******:** ***:.**:.**** human   CKDGLGEYTCTCLEGFEGKNCELFTRKLCSLDNGDCDQFCHEEQNSVVCSCARGYTLADN
rabbit  CKDGLGMYTCSCVEGYEGQDCEPVTRKLCSLDNGGCDQFCKEEENSVLCSCASGYTLGDN
        ****** ***:*:**:**::**  *********.******:***:**:****:****.**

human   GKACIPTGPYPCGKQTLERRKRSVAQATSSSGEAPDSITWKPYDAADLDPTENPFDLLDF
rabbit  GKSCISTELFPCGKVTLGRWRR--SPATNSSEGPPEAPGPEQQDDGNLTATENPFNLLDS
        :.*   **  * **  : * .**.  . * :.   :* .:*.****:* human   NQTQPERGDNNLTRIVGGQECKDGECPWQALLINEENEGFCGGTILSEFYILTAAHCLYQ
rabbit  PEPPPEDDSSLVRIVGGQDCRDGECPWQALLVNEENEGFCGGTILSEYHVLTAAHCLHQ
        .: ...:.*.*.*****:*:*********:************:::*****:* human   AKRFKVRVGDRNTEQEEGGEAVHEVEVVIKHNRFTKETYDFDIAVLRLKTPITFRMNVAP
rabbit  AKRFKVRVGDRDTEHEEGNEETHEVEVVKHNRFVKETYDFDIAVLRLKTPITFRRNVAP
        *********::*.:***:.*******************:* human   ACLPERDWAESTLMTQKTGIVSGFGRTHEKGRQSTRLKMLEVPYVDRNSCKLSSSFIITQ
rabbit  ACLPQKDWAESTLMAQKTGIVSGFGRTHEMGRLSTTLKMLEVPYVDRNSCKRSSSFTITQ
        **::****.********** . ********** * *** human   NMFCAGYDTKQEDACQGDSGGPHVTRFKDTYFVTGIVSWGEGCARKGKYGIYTKVTAFLK
rabbit  NMFCAGYDARPEDACQGDSGGPHVTRFRDTYFVTGIVSWGEGCARKGKFGVYTKVSNFLK
        ******:: ************:****************.*:***:.* human   WIDRSMKTRGLPKAKSHAPEVITSSPLK----
rabbit  WIEKSMRARAVPVAEAAGTPGPTQPTIKGSPS
        **::***: *    *  *  :    ....:*
```

FIGURE 3H

```
human  ANSFLEEMKKGHLERECMEETCSYEEAREVFEDSDKTNEFWNKYKDGDQCETSPCQNQGK
rat    ANSFFEEIKKGNLERECVEEICSFEEAREVFEDNEKTTEFWNKYEDGDQCESSPCQNQGE
       ****:***:*****:****:**:********:**:.:**:*********:****:******:

human  CKDGLGEYTCTCLEGFEGKNCELFTRKLCSLDNGDCDQFCHEEQNSVVCSCARGYTLADN
rat    CRDGLGSYTCTCTEGFEGKNCELFVRKLCSLDNGDCDQFCREEQNSVVCSCAKGYFLGND
       *:**.*.******.:**********:*****::* :* human  GKACIPTGPYPCGKQTLERRKRSVAQATSSSGEAPDSITWKPYDAADLDPTENPFDLLDF
rat    GKSCLSTAPFPCGKTNKGRAKRSVALNTSNSEPDPEDLMP---DADILYPTESPSELLNL
       **:*:.:* *.***  : *:****: .:*..*  * * **   ** * ***.*. **::

human  NQTQPERGDNNLTRIVGGQECKDGECPWQALLIN-EENEGFCGGTILSEFYILTAAHCLY
rat    NKTEPEANSDDVIRIVGGQECKRGECPWQALLFSDEETDGFCGGTILNEFYILTAAHCLH
       *:*:**  .*::.:*******:*********:. **: *********.*********:

human  QAKRFKVRVGDRNTEQEEGGEAVHEVEVVIKHNRFTKETYDFDIAVLRLKTPITFRMNVA
rat    QAKRFKVRVGDLNTEQEDGGEMVHEVDMIIKHNKFQRDTYDFDIAMLRLKTPITFRENVA
       ********* *:*.**::**:* : *****:***** * human  PACLPERDWAESTLMTQKTGIVSGFGRTHEKGRQSTRLKMLEVPYVDRNSCKLSSSFIIT
rat    PACLPQKDWAEATLMTQKTGIVSGFGRTHEKGRQSKVLKMMEVPYVDRNTCRLSTSFSIT
       *****::****:*********************: :***:********:*:**:**.**

human  QNMFCAGYDTKQEDACQGDSGGPHVTRFKDTYFVTGIVSWGEGCARKGKYGIYTKVTAFL
rat    QNMFCAGYDAKQEDACQGDSGGPHVTRFKDTYFVTGIVSWGEGCARKGKYGIYTKVTAFL
       *******:************************************************ human  KWIDRSMKTRGLPKAKSHAPEVITSSPLK
rat    KWIDRSMKARVGPTSETPRLTHPPY----
       ********:* **:::**: ****.
```

FIGURE 3I

```
human   ANSFLEEMKKGHLERECMEETCSYEEAREVFEDSDKTNEFWNKYKDGDQCETSPCQNQGK
dog     ANSFLEEMKKGNLERECMEETCSFEEAREVFEDTAKTMEFWNKYKDGDQCESSPCQNQGQ
        ***********::**********:********:*:*:****************:******:

human   CKDGLGEYTCTCLEGFEGKNCELFTRKLCSLDNGDCDQFCHEEQNSVVCSCARGYTLADN
dog     CKDGLLEYSCICLEGYEGKNCELSTRKLCSVDNGDCDQFCREEQSSVVCSCASGYILGDN
        *****:**:*:****:*******:******:*********::***:******:**:*.**

human   GKACIPTGPYPCGKQTLERRKRSVAQATSSSGE--APDSITWKPYDAADLDPTENPFDL
dog     GKSCISTEPFPCGKTTVGRRKRATETAPSSEAPPDAEEEAGMLEQYDPGDLSPTQSTMFL
        ::* *:**** *:*****:*: *.**:  .*:  ..* .**  *.  . : * * human   LDFNQTQ--PERGDNNLTRIVGGQECKDGECPWQALLINEENEGFCGGTILSEFYILTAA
dog     LPFNQTNSDPDEDASGLVRIVGGQDCRDGECPWQALLINEENEGFCGGTILSEYYILTAA
        * ****.  *: *.. *.****:* :****************:**** human   HCLYQAKRFKVRVGDRNTEQEEGGEAVHEVEVVIKHNRFTKETYDFDIAVLRLKTPITFR
dog     HCLQQAKKFTVRVGERDTDKEEGNEVAHEVEMIIKHNKFVRETYDFDIAVIKLKTPITFR
        * *:*.****:*:*::**.:**::**:* *******::****** human   MNVAPACLPERDWAESTLMTQKTGIVSGFGRTHEKGRQSTRLKMLEVPYVDRNSCKLSSS
dog     MNVAPACLPQKDWAESTLMTQKTGIVSGFGKTHEKGRPSTTLKMMEVPYVDRNTCKLSSS
        *******::*************:**:.**:**** ***** human   FIITQNMFCAGYDTKQEDACQGDSGGPHVTRFKDTYFVTGIVSWGEGCARKGKYGIYTKV
dog     FSITQNMFCAGYDSKPEDACQGDSGGPHVTRFKDTYFVTGIVSWGEGCARKGKYGIYTKV
        * ***********:* ******************.******************* human   TAFLKWIDRSMKTRG---LPKAKSHAPEVITSSPLK--
dog     TNFLKWIDRSMKARAGWGGFFGKKERPPSLWADPPPGPC
        *.***********:*    * *:*.   * *:. :..*
```

FIGURE 3J

```
human     ANSFLEEMKKGHLERECMEETCSYEEAREVFEDSDKTNEFWNKYKDGDQCETSPCQNQGK
I195L     ANSFLEEMKKGHLERECMEETCSYEEAREVFEDSDKTNEFWNKYKDGDQCETSPCQNQGK
          ************************************************************ human     CKDGLGEYTCTCLEGFEGKNCELFTRKLCSLDNGDCDQFCHEEQNSVVCSCARGYTLADN
I195L     CKDGLGEYTCTCLEGFEGKNCELFTRKLCSLDNGDCDQFCHEEQNSVVCSCARGYTLADN
          ************************************************************ human     GKACIPTGPYPCGKQTLERRKRSVAQATSSSGEAPDSITWKPYDAADLDPTENPFDLLDF
I195L     GKACIPTGPYPCGKQTLERRKRSVAQATSSSGEAPDSITWKPYDAADLDPTENPFDLLDF
          ************************************************************ human     NQTQPERGDNNLTRIVGGQECKDGECPWQALLINEENEGFCGGTILSEFYILTAAHCLYQ
I195L     NQTQPERGDNNLTRLVGGQECKDGECPWQALLINEENEGFCGGTILSEFYILTAAHCLYQ
          **************:********************************************* human     AKRFKVRVGDRNTEQEEGGEAVHEVEVVIKHNRFTKETYDFDIAVLRLKTPITFRMNVAP
I195L     AKRFKVRVGDRNTEQEEGGEAVHEVEVVIKHNRFTKETYDFDIAVLRLKTPITFRMNVAP
          ************************************************************ human     ACLPERDWAESTLMTQKTGIVSGFGRTHEKGRQSTRLKMLEVPYVDRNSCKLSSSFIITQ
I195L     ACLPERDWAESTLMTQKTGIVSGFGRTHEKGRQSTRLKMLEVPYVDRNSCKLSSSFIITQ
          ************************************************************ human     NMFCAGYDTKQEDACQGDSGGPHVTRFKDTYFVTGIVSWGEGCARKGKYGIYTKVTAFLK
I195L     NMFCAGYDTKQEDACQGDSGGPHVTRFKDTYFVTGIVSWGEGCARKGKYGIYTKVTAFLK
          ************************************************************ human     WIDRSMKTRGLPKAKSHAPEVITSSPLK
I195L     WIDRSMKTRGLPKAKSHAPEVITSSPLK
          ****************************
```

FIGURE 3K

```
human   ANSFLEEMKKGHLERECMEETCSYEEAREVFEDSDKTNEFWNKYKDGDQCETSPCQNQGK
Ap152T  ANSFLEEMKKGHLERECMEETCSYEEAREVFEDSDKTNEFWNKYKDGDQCETSPCQNQGK
        ************************************************************ human   CKDGLGEYTCTCLEGFEGKNCELFTRKLCSLDNGDCDQFCHEEQNSVVCSCARGYTLADN
Ap152T  CKDGLGEYTCTCLEGFEGKNCELFTRKLCSLDNGDCDQFCHEEQNSVVCSCTRGYTLADN
        ***********************************************.******* human   GKACIPTGPYPCGKQTLERRKRSVAQATSSSGEAPDSITWKPYDAADLDPTENPFDLLDF
Ap152T  GKACIPTGPYPCGKQTLERRKRSVAQATSSSGEAPDSITWKPYDAADLDPTENPFDLLDF
        ************************************************************ human   NQTQPERGDNNLTRIVGGQECKDGECPWQALLINEENEGFCGGTILSEFYILTAAHCLYQ
Ap152T  NQTQPERGDNNLTRIVGGQECKDGECPWQALLINEENEGFCGGTILSEFYILTAAHCLYQ
        ************************************************************ human   AKRFKVRVGDRNTEQEEGGEAVHEVEVVIKHNRFTKETYDFDIAVLRLKTPITFRMNVAP
Ap152T  AKRFKVRVGDRNTEQEEGGEAVHEVEVVIKHNRFTKETYDFDIAVLRLKTPITFRMNVAP
        ************************************************************ human   ACLPERDWAESTLMTQKTGIVSGFGRTHEKGRQSTRLKMLEVPYVDRNSCKLSSSFIITQ
Ap152T  ACLPERDWAESTLMTQKTGIVSGFGRTHEKGRQSTRLKMLEVPYVDRNSCKLSSSFIITQ
        ************************************************************ human   NMFCAGYDTKQEDACQGDSGGPHVTRFKDTYFVTGIVSWGEGCARKGKYGIYTKVTAFLK
Ap152T  NMFCAGYDTKQEDACQGDSGGPHVTRFKDTYFVTGIVSWGEGCARKGKYGIYTKVTAFLK
        ************************************************************ human   WIDRSMKTRGLPKAKSHAPEVITSSPLK
Ap152T  WIDRSMKTRGLPKAKSHAPEVITSSPLK
        ****************************
```

MODIFIED FACTOR X POLYPEPTIDES AND USES THEREOF

RELATED APPLICATIONS

Benefit of priority is claimed to U.S. Provisional Application Ser. No. 61/741,806, entitled "Modified Factor X Polypeptides and Uses Thereof," filed on Jul. 25, 2012.

This application is related to International PCT Application Serial No. PCT/US2013/032616, filed the same day herewith, entitled "Modified Factor X Polypeptides and Uses Thereof," which claims priority to U.S. Provisional Application No. 61/741,806.

The subject matter of each of the above-noted applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Mar. 15, 2013 is identical, 1.68 megabytes in size, and titled 4941SEQ.001.txt.

FIELD OF THE INVENTION

Modified therapeutic proteins are provided. In particular modified Factor X polypeptides, which includes the Factor X zymogen, Factor Xa and other forms of Factor X, and uses thereof are provided.

BACKGROUND

Hemostasis is the complex physiological process that leads to the cessation of bleeding. Platelets, plasma proteins, and blood vessels and endothelial cells are the three components of this process that each play an important role in the events that immediately follow tissue injury and which, under normal circumstances, results in the rapid formation of a clot. Central to this is the coagulation cascade, a series of proteolytic events in which certain plasma proteins (or coagulation factors) are sequentially activated in a "cascade" by another previously activated coagulation factor, leading to the rapid generation of thrombin. The large quantities of thrombin produced in this cascade then function to cleave fibrinogen into the fibrin peptides that are required for clot formation. Factor X (FX) has been proposed as a therapeutic to treat bleeding disorders, and is advantageous over other coagulation factor therapeutics because of its central role in the coagulation pathway. Current treatments with FX are based on the therapeutic use of non-activated zymogen because it is considered to be a safer approach. There is a need for improved or alternative FX therapeutics.

SUMMARY

Provided herein are modified or variant Factor X (FX) polypeptides that exhibit altered properties or activities compared to an unmodified FX polypeptide such as increased cofactor (FVa) dependence, increased half-life, increased resistance to inhibitors (e.g. antithrombin III) and/or altered glycosylation. The modified FX polypeptides provided herein can exhibit some or all of the above properties or activities. The modified FX polypeptides can be mature, zymogen, active or activated or catalytically active forms thereof.

For example, provided herein are modified FX polypeptide that contain an amino acid replacement in an unmodified FX polypeptide such that the active FX (FXa) form of the modified FX polypeptide exhibits at least 2-fold, 10-fold, 20-fold, 30-fold, 40-fold, and generally at least 50-fold increased FVa cofactor dependence compared to the FXa polypeptide that is the same as the modified FX polypeptide, but not containing the amino acid replacement(s). The unmodified FX polypeptide has the sequence of amino acids set forth in SEQ ID NO:134, or is the zymogen, active or catalytically active form thereof, or has a sequence of amino acids that has at least 75% sequence identity to SEQ ID NO:134 or the zymogen, active or catalytically active form thereof. In one example, the unmodified FX polypeptide can be a zymogen FX polypeptide having a light chain containing the sequence of amino acids set forth as residues 1-139 of SEQ ID NO:134, and a heavy chain containing the sequence of amino acids set forth as residues 143-448 of SEQ ID NO:134, or a sequence of amino acids that exhibits at least 75% sequence identity to the zymogen FX polypeptide having a light chain containing the sequence of amino acids set forth as residues 1-139 of SEQ ID NO:134, and a heavy chain containing the sequence of amino acids set forth as residues 143-448 of SEQ ID NO:134. In another example, the unmodified FX polypeptide is an active FX (FXa) polypeptide having a light chain containing the sequence of amino acids set forth as residues 1-139 of SEQ ID NO:134, and a heavy chain containing the sequence of amino acids set forth as residues 195-448 of SEQ ID NO:134, or a sequence of amino acids that exhibits at least 75% sequence identity to the FXa having a light chain containing the sequence of amino acids set forth as residues 1-139 of SEQ ID NO:134, and a heavy chain containing the sequence of amino acids set forth as residues 195-448 of SEQ ID NO:134. In a further example, the unmodified FXa polypeptide is a catalytically active for the of the active FXa described above. Any of the unmodified FX polypeptide can have at least 80%, 85%, 86%, 87%, 88%, 89%, 90%, 91%, 92%, 93%, 94%, 95%, 96%, 97%, 98%, 99% or more sequence identity to SEQ ID NO:134 or the zymogen, active or catalytically active form thereof.

In particular examples of the modified FX polypeptides provided above and herein, the mature or zymogen form of the modified FX polypeptide does not contain a heterologous activation peptide from another serine protease. In other examples, herein the mature or zymogen form of the modified FX polypeptide does not contain a modified activation peptide. In additional examples herein, the FXa form of the modified FX polypeptide, or catalytically active portion thereof, is not produced from a zymogen FX polypeptide containing a heterologous activation peptide from another serine protease or a modified activation peptide. The modified FX polypeptides can be isolated or substantially purified or purified.

Also provided herein are isolated modified active Factor X (FXa) polypeptides containing an amino acid replacement in an unmodified FX polypeptide, wherein the active FX (FXa) form of the modified FX polypeptide exhibits increased cofactor dependence, such as at least 2-fold, 3-fold, 4-fold, 5-fold, 10-fold, 20-fold, 30-fold, 40-fold, and generally at least 50-fold increased FVa cofactor dependence compared to the FXa polypeptide that is the same as the modified FX polypeptide, but not containing the amino acid replacement(s). The modified FXa does not generally contain an activation peptide. The unmodified FX polypeptide can be an active FX (FXa) polypeptide containing a sequence of amino acids that exhibits at least 75% sequence identity to the FXa having a light chain having the sequence of amino acids set forth as residues 1-139 of SEQ ID NO:134, and a heavy chain having the sequence of amino acids set forth as residues 195-448 of SEQ ID NO:134, or is a catalytically active form thereof.

In any of the examples of the modified FX polypeptides or isolated modified FX polypeptides provided herein that exhibit increased co-factor dependence, the co-factor dependence can be increased at least 75-fold, 100-fold, 125-fold, 150-fold, 200-fold, 250-fold, 300-fold, 350-fold, 400-fold, 450-fold, 500-fold, 600-fold, 700-fold, 800-fold, 900-fold, 1000-fold, 2000-fold or more compared to the unmodified polypeptide.

Included among such modified FX polypeptides or isolated modified FX polypeptides provided herein are polypeptides whereby the native amino acid residue at position 196 with reference to amino acid positions set forth in SEQ ID NO:134 or a residue that corresponds to amino acid residue 196 in the unmodified FX polypeptide is replaced with a neutral polar amino acid residue. For example, the neutral polar amino acid is selected an asparagine (N), glutamine (Q), serine (S), threonine (T), tryptophan (W), cysteine (C) and tyrosine (Y), and generally is a serine (S) or threonine (T). The corresponding amino acid residues (i.e. the amino acid residues that corresponds to position 196 in a FX polypeptide other than that set forth in SEQ ID NQ:4) are identified by alignment of the unmodified FX polypeptide with the polypeptide of SEQ ID NO:134. This is exemplified in FIGS. 3A-3K. For example, provided herein are modified FX polypeptides that contain an amino acid replacement with S at a position corresponding to position 196 or an amino acid replacement with a T at a position corresponding to position 196 with reference to amino acid positions set forth in SEQ ID NO:134, or the same amino acid replacement at a corresponding amino acid residue in the unmodified FX polypeptide that does not comprises S or T at the position corresponding to 196. In particular examples, the modified FX polypeptide contains an amino acid replacement with S at a position corresponding to position 196 with reference to amino acid position set forth in SEQ ID NO:134, or the same replacement at a corresponding amino acid residue in the unmodified FX polypeptide that does not comprise S at the position corresponding to 196.

In any of the examples of the modified FX polypeptides or isolated FX polypeptides provided herein or described above, the polypeptide can contain a further amino acid replacement(s) in the light chain or in the protease domain of the heavy chain. In other examples, the amino acid replacement described above at position 196 is the only modification in the polypeptide. Hence, modified FX polypeptides or isolated modified FX polypeptide provided herein can contain only one, two, three, four, five, six, seven, eight, nine, ten, eleven, twelve, thirteen, fourteen, fifteen, sixteen, seventeen, eighteen, nineteen, or twenty amino acid replacement(s) compared to the unmodified polypeptide of the same form, for example, the unmodified polypeptide that has the sequence of amino acids set forth in SEQ ID NO:134 or the zymogen, active or catalytically active form thereof.

In any of the examples herein, the further amino acid replacement(s) does not correspond to replacement with Isoleucine (I), Alanine (A), Valanine (V), Serine (S) or Threonine (T) at a position corresponding to position 195 or 197 with reference to amino acid positions set forth in SEQ ID NO:134, or the same replacement at a corresponding amino acid residue in the unmodified FX polypeptide. The further amino acid replacement(s) can result in or confer or effect altered glycosylation, increased resistance to an inhibitor and/or increased catalytic activity. For example, the increased resistance to an inhibitor can be increased resistance to anti-thrombin III (ATIII).

In particular examples herein, any of the modified FX polypeptide or isolated modified FX polypeptide described herein or above has an amino acid replacement(s) at an amino acid position corresponding to a position selected from among 211, 214, 216, 218, 219, 273, 276, 306, 326, 332, 338, 420 and 424, with reference to amino acid positions set forth in SEQ ID NO:134, wherein corresponding amino acid positions are identified by alignment of the unmodified FX polypeptide with the polypeptide set forth in SEQ ID NO:134. For example, the amino acid replacement(s) can be amino acid replacement(s) with: S at a position corresponding to position 211; D at a position corresponding to position 214; A at a position corresponding to position 214; S at a position corresponding to position 214; R at a position corresponding to position 216; K at a position corresponding to position 216; A at a position corresponding to position 216; S at a position corresponding to position 216; R at a position corresponding to position 218; K at a position corresponding to position 218; A at a position corresponding to position 218; H at a position corresponding to position 219; A at a position corresponding to position 273; E at a position corresponding to position 273; A at a position corresponding to position 276; E at a position corresponding to position 276; E at a position corresponding to position 306; S at a position corresponding to position 326; T at a position corresponding to position 326; V at a position corresponding to position 326; Q at a position corresponding to position 326; N at a position corresponding to position 326; M at a position corresponding to position 326; K at a position corresponding to position 326; Y at a position corresponding to position 326; E at a position corresponding to position 326; D at a position corresponding to position 326; A at a position corresponding to position 332; D at a position corresponding to position 332; E at a position corresponding to position 332; S at a position corresponding to position 332; G at a position corresponding to position 332; A at a position corresponding to position 338; S at a position corresponding to position 338; N at a position corresponding to position 338; R at a position corresponding to position 338; V at a position corresponding to position 338; Y at a position corresponding to position 338; M at a position corresponding to position 338; A at a position corresponding to position 420; E at a position corresponding to position 420; A at a position corresponding to position 424; or E at a position corresponding to position 424, with reference to amino acid positions set forth in SEQ ID NO:134, or the same replacement(s) at a corresponding amino acid residue in the unmodified FX polypeptide.

For example, among the modified FX polypeptides or isolated modified FX polypeptides provided herein, including any described above, are FX polypeptides containing amino acid replacement(s): S at a position corresponding to position 196, S at a position corresponding to position 211 and H at a position corresponding to position 219; S at a position corresponding to position 196, and D at a position corresponding to position 214; S at a position corresponding to position 196 and A at a position corresponding to position 214; S at a position corresponding to position 196 and S at a position corresponding to position 214; S at a position corresponding to position 196 and R at a position corresponding to position 216; S at a position corresponding to position 196 and K at a position corresponding to position 216; S at a position corresponding to position 196 and A at a position corresponding to position 216; S at a position corresponding to position 196 and S at a position corresponding to position 216; S at a position corresponding to position 196 and R at a position corresponding to position 218; S at a position corresponding to position 196 and K at a position corresponding to position 218; S at a position corresponding to position 196 and A at a position corresponding to position 218; S at a position corresponding to position 196 and E at a position corresponding to position 273; S at a position corresponding to position 196 and A at a position corresponding to position 273; S at a position corresponding to position 196 and A at a position corresponding to position 276; S at a position corresponding to position 196 and E at a position corresponding to position 276; S at a position corresponding to position 196 and E at a position corresponding to position 306; S at a position corresponding to position 196 and E at a position corresponding to position 326; S at a position corresponding to position 196 and D at a position corresponding to position 326; S at a position corresponding to position 196 and M at a position corresponding to position 326; S at a position corresponding to position 196 and N at a position corresponding to position 326; S at a position corresponding to position 196 and Q at a position corresponding to position 326; S at a position corresponding to position 196 and A at a position corresponding to position 332; S at a position corresponding to position 196 and D at a position corresponding to position 332; S at a position corresponding to position 196 and E at a position corresponding to position 332; S at a position corresponding to position 196 and S at a position corresponding to position 332; S at a position corresponding to position 196 and G at a position corresponding to position 332; S at a position corresponding to position 196 and A at a position corresponding to position 338; S at a position corresponding to position 196 and S at a position corresponding to position 338; S at a position corresponding to position 196 and A at a position corresponding to position 420; S at a position corresponding to position 196 and E at a position corresponding to position 420; S at a position corresponding to position 196 and A at a position corresponding to position 424; S at a position corresponding to position 196 and E at a position corresponding to position 424; or S at a position corresponding to position 196, E at a position corresponding to position 420 and E at a position corresponding to position 424, with reference to amino acid positions set forth in SEQ ID NO:134 or the same amino acid replacement at a corresponding amino acid residue in the unmodified FX polypeptide, or the same replacement(s) at a corresponding amino acid residue in the unmodified FX polypeptide.

In any of the modified FX polypeptides or isolated modified FX polypeptides provided herein, including any described above, the modified FX polypeptide can contain amino acid replacement(s) that alters glycosylation by introduction of a non-native glycosylation site. For example, the non-native glycosylation site can be introduced by amino acid replacement(s) with: N at a position corresponding to position 51; N at a position corresponding to position 56 and S at a position corresponding to position 58; N at a position corresponding to position 62 and S at a position corresponding to position 64; N at a position corresponding to position 65 and S at a position corresponding to position 67; N at a position corresponding to position 67; N at a position corresponding to position 73 and S at a position corresponding to position 75; N at a position corresponding to position 75 and S at a position corresponding to position 77; N at a position corresponding to position 77 and S at a position corresponding to position 79; N at a position corresponding to position 78 and S at a position corresponding to position 80; S at a position corresponding to position 82; N at a position corresponding to position 83; N at a position corresponding to position 82 and S at a position corresponding to position 84; N at a position corresponding to position 85 and S at a position corresponding to position 87; N at a position corresponding to position 86 and S at a position corresponding to position 88; N at a position corresponding to position 95 and S at a position corresponding to position 97; N at a position corresponding to position 114; N at a position corresponding to position 119 and S at a position corresponding to position 121; S at a position corresponding to position 122; N at a position corresponding to position 215 and S at a position corresponding to position 217; N at a position corresponding to position 243 and S at a position corresponding to position 245; N at a position corresponding to position 264 and S at a position corresponding to position 266; N at a position corresponding to position 293 and S at a position corresponding to position 295; N at a position corresponding to position 388; N at a position corresponding to position 389 and S at a position corresponding to position 391; N at a position corresponding to position 428 and S at a position corresponding to position 430; or N at a position corresponding to position 429 and S at a position corresponding to position 431, with reference to amino acid positions set forth in SEQ ID NO:134, or the same replacement(s) at a corresponding amino acid residue in the unmodified FX polypeptide.

For example, among the modified FX polypeptides or isolated modified FX polypeptides provided herein, including any described above, are modified FX polypeptides containing amino acid replacement(s) with: S at a position corresponding to position 196 and N at a position corresponding to position 51; S at a position corresponding to position 196, N at a position corresponding to position 56 and S at a position corresponding to position 58; S at a position corresponding to position 196, N at a position corresponding to position 58 and S at a position corresponding to position 60; S at a position corresponding to position 196, N at a position corresponding to position 62 and S at a position corresponding to position 64; S at a position corresponding to position 196, N at a position corresponding to position 65 and S at a position corresponding to position 67; S at a position corresponding to position 196 and N at a position corresponding to position 67; S at a position corresponding to position 196, N at a position corresponding to position 73 and S at a position corresponding to position 75; S at a position corresponding to position 196, N at a position corresponding to position 75 and S at a position corresponding to position 77; S at a position corresponding to position 196, N at a position corresponding to position 77 and S at a position corresponding to position 79; S at a position corresponding to position 196, N at a position corresponding to position 78 and S at a position corresponding to position 80; S at a position corresponding to position 196 and S at a position corresponding to position 82; S at a position corresponding to position 196 and N at a position corresponding to position 83; S at a position corresponding to position 196, N at a position corresponding to position 82 and S at a position corresponding to position 84; S at a position corresponding to position 196, N at a position corresponding to position 85 and S at a position corresponding to position 87; S at a position corresponding to position 196, N at a position corresponding to position 86 and S at a position corresponding to position 88; S at a position corresponding to position 196, N at a position corresponding to position 95 and S at a position corresponding to position 97; S at a position corresponding to position 196 and N at a position corresponding to position 114; S at a position corresponding to position 196, N at a position corresponding to position 114, S at a position corresponding to position 211 and H at a position corresponding to position 219; S at a position corresponding to position 196, N at a position corresponding to position 119 and S at a position corresponding to position 121; S at a position corresponding to position 196, N at a position corresponding to position 114, N at a position corresponding to position 119 and S at a position corresponding to position 121; S at a position corresponding to position 196, N at a position corresponding to position 114, N at a position corresponding to position 119, S at a position corresponding to position 121, S at a position corresponding to position 211 and H at a position corresponding to position 219; S at a position corresponding to position 196, N at a position corresponding to position 119, S at a position corresponding to position 121, S at a position corresponding to position 211 and H at a position corresponding to position 219; S at a position corresponding to position 196 and S at a position corresponding to position 122; S at a position corresponding to position 196, N at a position corresponding to position 215 and S at a position corresponding to position 217; S at a position corresponding to position 196, N at a position corresponding to position 243 and S at a position corresponding to position 245; S at a position corresponding to position 196, N at a position corresponding to position 264 and S at a position corresponding to position 266; S at a position corresponding to position 196, N at a position corresponding to position 119, S at a position corresponding to position 121, N at a position corresponding to position 264 and S at a position corresponding to position 266; S at a position corresponding to position 196, S at a position corresponding to position 211, H at a position corresponding to position 219, N at a position corresponding to position 264 and S at a position corresponding to position 266; S at a position corresponding to position 196, N at a position corresponding to position 119, S at a position corresponding to position 121, S at a position corresponding to position 211, H at a position corresponding to position 219, N at a position corresponding to position 264 and S at a position corresponding to position 266; S at a position corresponding to position 196, N at a position corresponding to position 114, N at a position corresponding to position 264 and S at a position corresponding to position 266; S at a position corresponding to position 196, N at a position corresponding to position 114, S at a position corresponding to position 211, H at, a position corresponding to position 219, N at a position corresponding to position 264 and S at a position corresponding to position 266; S at a position corresponding to position 196, N at a position corresponding to position 264, S at a position corresponding to position 266 and N at a position corresponding to position 388; S at a position corresponding to position 196, N at a position corresponding to position 293 and S at a position corresponding to position 295; S at a position corresponding to position 196 and N at a position corresponding to position 388; S at a position corresponding to position 196, N at a position corresponding to position 119, S at a position corresponding to position 121 and N at a position corresponding to position 388; S at a position corresponding to position 196, N at a position corresponding to position 114, S at a position corresponding to position 211, H at a position corresponding to position 219 and N at a position corresponding to position 388; S at a position corresponding to position 196, S at a position corresponding to position 211, H at a position corresponding to position 219, N at a position corresponding to position 264, S at a position corresponding to position 266 and N at a position corresponding to position 388; S at a position corresponding to position 196, N at a position corresponding to position 119, S at a position corresponding to position 121, S at a position corresponding to position 211, H at a position corresponding to position 219 and N at a position corresponding to position 388; S at a position corresponding to position 196, N at a position corresponding to position 389 and S at a position corresponding to position 391; S at a position corresponding to position 196, N at a position corresponding to position 428 and S at a position corresponding to position 430; or S at a position corresponding to position 196, N at a position corresponding to position 429 and S at a position corresponding to position 431, with reference to amino acid positions set forth in SEQ ID NO:134, or the same replacement(s) at a corresponding amino acid residue in the unmodified FX polypeptide.

In one example, provided herein are modified FX polypeptides or isolated modified FX polypeptides that contain a sequence of amino acids set forth in any of SEQ ID NOS: 137-157, 169, 205-208, 214-243 and 246-265, or a sequence of amino acids that exhibits at least 75% sequence identity to any of the sequence of amino acids set forth in any of SEQ ID NOS: 137-157, 169, 205-208, 214-243 and 246-265 and that contains the amino acid replacement(s). In another example, provided herein are modified FX polypeptides or isolated modified FX polypeptides that contain a sequence of amino acids containing a light chain having the sequence of amino acids set forth as residues 1-139 and a heavy chain having the sequence of amino acids set forth as residues 143-448 of any of SEQ ID NOS: 137-157, 169, 205-208, 214-243 and 246-265, or a sequence of amino acids that exhibits at least 75% sequence identity to any of the sequence of amino acids containing a light chain having the sequence of amino acids set forth as residues 1-139 and a heavy chain having the sequence of amino acids set forth as residues 143-448 of any of SEQ ID NOS: 137-157, 169, 205-208, 214-243 and 246-265 and that contains the amino acid replacement(s). In a further example, provided herein are modified FX polypeptides or isolated modified FX polypeptides that contain a sequence of amino acids containing a light chain having the sequence of amino acids set forth as residues 1-139 and a heavy chain having the sequence of amino acids set forth as residues 195-448 of any of SEQ ID NOS: 137-157, 169, 205-208, 214-243 and 246-265, or a sequence of amino acids that exhibits at least 75% sequence identity to any of the sequence of amino acids containing a light chain having the sequence of amino acids set forth as residues 1-139 and a heavy chain having the sequence of amino acids set forth as residues 195-448 of any of SEQ ID NOS: 137-157, 169, 205-208, 214-243 and 246-265 and that contains the amino acid replacement(s). In an additional example, provided herein are modified FX polypeptides or isolated modified FX polypeptides that contain a catalytically active form of any of the above forms that includes the modification(s) and exhibits catalytic activity.

Provided herein are modified Factor X (FX) polypeptides containing an amino acid replacement in an unmodified FX polypeptide at a native amino acid residue that is 198, 202, 211, 214, 217, 219, 327 and/or 338 with reference to amino acid positions set forth in SEQ ID NO:134, or a residue that corresponds to an amino acid residue 198, 202, 211, 214, 217, 219, 327 and/or 338, whereby the modified FX polypeptide exhibits FVa-dependent catalytic activity. In such examples, corresponding amino acid residues are identified by alignment of the unmodified FX polypeptide with the polypeptide of SEQ ID NO:134, for example, as exemplified in FIGS. 3A-3K. The unmodified FX polypeptide has the sequence of amino acids set forth in SEQ ID NO:134, or is the zymogen, active or catalytically active form thereof, or has a sequence of amino acids that has at least 75% sequence identity to SEQ ID NO:134 or a zymogen, active or catalytically active form thereof. In one example, the unmodified FX polypeptide can be a zymogen FX polypeptide having a light chain containing the sequence of amino acids set forth as residues 1-139 of SEQ ID NO:134, and a heavy chain containing the sequence of amino acids set forth as residues 143-448 of SEQ ID NO:134, or a sequence of amino acids that exhibits at least 75% sequence identity to the zymogen FX polypeptide having a light chain containing the sequence of amino acids set forth as residues 1-139 of SEQ ID NO:134, and a heavy chain containing the sequence of amino acids set forth as residues 143-448 of SEQ ID NO:134. In another example, the unmodified FX polypeptide is an active FX (FXa) polypeptide having a light chain containing the sequence of amino acids set forth as residues 1-139 of SEQ ID NO:134, and a heavy chain containing the sequence of amino acids set forth as residues 195-448 of SEQ ID NO:134, or a sequence of amino acids that exhibits at least 75% sequence identity to the FXa having a light chain containing the sequence of amino acids set forth as residues 1-139 of SEQ ID NO:134, and a heavy chain containing the sequence of amino acids set forth as residues 195-448 of SEQ ID NO:134. In a further example, the unmodified FXa polypeptide is a catalytically active for the of the active FXa described above. Any of the unmodified FX polypeptide can have at least 80%, 85%, 86%, 87%, 88%, 89%, 90%, 91%, 92%, 93%, 94%, 95%, 96%, 97%, 98%, 99% or more sequence identity to SEQ ID NO:134 or the zymogen, active or catalytically active form thereof. Such modified FX polypeptides can be isolated or substantially purified.

For example, modified FX polypeptides provided herein contain amino acid replacement(s) with: S at a position corresponding to position 202; S at a position corresponding to position 211; D at a position corresponding to position 214; A at a position corresponding to position 214; S at a position corresponding to position 214; S at a position corresponding to position 217; H at a position corresponding to position 219; A at a position corresponding to position 327; L at a position corresponding to position 327; A at a position corresponding to position 338; S at a position corresponding to position 338; N at a position corresponding to position 338; R at a position corresponding to position 338; V at a position corresponding to position 338; Y at a position corresponding to position 338 and M at a position corresponding to position 338, with reference to amino acid positions set forth in SEQ ID NO:134, or the same replacement(s) at a corresponding amino acid residue in the unmodified FX polypeptide.

In particular examples of the modified FX polypeptide provided herein, the modified FX polypeptide contains amino acid replacements with S at a position corresponding to position 211 and H at a position corresponding to position 219, with reference to amino acid positions set forth in SEQ ID NO:134, or the same replacements at a corresponding amino acid residue in the unmodified FX polypeptide. For example, modified FX polypeptides provided herein include those that contain amino acid replacement(s) with: S at a position corresponding to position 196, S at a position corresponding to position 211 and H at a position corresponding to position 219; A at a position corresponding to position 197, S at a position corresponding to position 214 and H at a position corresponding to position 219; or L at a position corresponding to position 195, S at a position corresponding to position 211 and H at a position corresponding to position 219, with reference to amino acid positions set forth in SEQ ID NO:134, or the same replacements at a corresponding amino acid residue in the unmodified FX polypeptide.

In other examples of modified FX polypeptides provided herein, the modified FX polypeptide contains amino acid replacement(s) with A at a position corresponding to position 327 and A at a position corresponding to position 338; or amino acid replacement(s) with L at a position corresponding to position 327 and M at a position corresponding to position 338, each with reference to amino acid positions set forth in SEQ ID NO:134, or the same replacements at a corresponding amino acid residue in the unmodified FX polypeptide. For example, provided herein are modified FX polypeptides containing amino acid replacement(s) with V at a position corresponding to position 200, L at a position corresponding to position 327, and M at a position corresponding to position 338; or amino acid replacement(s) with V at a position corresponding to position 200, L at a position corresponding to position 327, A at a position corresponding to position 334 and M at a position corresponding to position 338.

Provided herein are modified Factor X (FX) polypeptides containing an amino acid replacement in an unmodified FX polypeptide that is S at a position corresponding to position 197; A at a position corresponding to position 200; V at a position corresponding to position 200; S at a position corresponding to position 326; T at a position corresponding to position 326; V at a position corresponding to position 326; N at a position corresponding to position 326, M at a position corresponding to position 326; K at a position corresponding to position 326; Y at a position corresponding to position 326; A at a position corresponding to position 327; L at a position corresponding to position 327; A at a position corresponding to position 334; T at a position corresponding to position 334; N at a position corresponding to position 334; E at a position corresponding to position 336; A at a position corresponding to position 338; S at a position corresponding to position 338; N at a position corresponding to position 338; R at a position corresponding to position 338; V at a position corresponding to position 338; Y at a position corresponding to position 338; and/or M at a position corresponding to position 338, each with reference to amino acid positions set forth in SEQ ID NO:134, or the same replacements at a corresponding amino acid residue in the unmodified FX polypeptide, whereby the modified FX polypeptide exhibits FVa-dependent catalytic activity. In such examples, corresponding amino acid residues are identified by alignment of the unmodified FX polypeptide with the polypeptide of SEQ ID NO:134, for example, as exemplified in FIGS. 3A-3K. The unmodified FX polypeptide has the sequence of amino acids set forth in SEQ ID NO:134, or is the zymogen, active or catalytically active form thereof, or has a sequence of amino acids that has at least 75% sequence identity to SEQ ID NO:134 or a zymogen, active or catalytically active form thereof. In one example, the unmodified FX polypeptide can be a zymogen FX polypeptide having a light chain containing the sequence of amino acids set forth as residues 1-139 of SEQ ID NO:134, and a heavy chain containing the sequence of amino acids set forth as residues 143-448 of SEQ ID NO:134, or a sequence of amino acids that exhibits at least 75% sequence identity to the zymogen FX polypeptide having a light chain containing the sequence of amino acids set forth as residues 1-139 of SEQ ID NO:134, and a heavy chain containing the sequence of amino acids set forth as residues 143-448 of SEQ ID NO:134. In another example, the unmodified FX polypeptide is an active FX (FXa) polypeptide having a light chain containing the sequence of amino acids set forth as residues 1-139 of SEQ ID NO:134, and a heavy chain containing the sequence of amino acids set forth as residues 195-448 of SEQ ID NO:134, or a sequence of amino acids that exhibits at least 75% sequence identity to the FXa having a light chain containing the sequence of amino acids set forth as residues 1-139 of SEQ ID NO:134, and a heavy chain containing the sequence of amino acids set forth as residues 195-448 of SEQ ID NO:134. In a further example, the unmodified FXa polypeptide is a catalytically active for the of the active FXa described above. Any of the unmodified FX polypeptide can have at least 80%, 85%, 86%, 87%, 88%, 89%, 90%, 91%, 92%, 93%, 94%, 95%, 96%, 97%, 98%, 99% or more sequence identity to SEQ ID NO:134 or the zymogen, active or catalytically active form thereof. Such modified FX polypeptides can be isolated or substantially purified.

In such examples of modified FX polypeptides provided herein, the modified FX polypeptide can also contain amino acid replacement(s) S at a position corresponding to position 196, I at a position corresponding to position 196; L at a position corresponding to position 196; T at a position corresponding to position 196; A at a position corresponding to position 326 and/or Q at a position corresponding to position 326.

The modified FX polypeptides provided herein, including any that exhibit FVa-dependent catalytic activity, can contain amino acid replacement(s) that alters glycosylation by introduction of a non-native glycosylation site. For example, the non-native glycosylation site can be introduced by amino acid replacement(s) with: N at a position corresponding to position 51; N at a position corresponding to position 56 and S at a position corresponding to position 58; N at a position corresponding to position 62 and S at a position corresponding to position 64; N at a position corresponding to position 65 and S at a position corresponding to position 67; N at a position corresponding to position 67; N at a position corresponding to position 73 and S at a position corresponding to position 75; N at a position corresponding to position 75 and S at a position corresponding to position 77; N at a position corresponding to position 77 and S at a position corresponding to position 79; N at a position corresponding to position 78 and S at a position corresponding to position 80; S at a position corresponding to position 82; N at a position corresponding to position 83; N at a position corresponding to position 82 and S at a position corresponding to position 84; N at a position corresponding to position 85 and S at a position corresponding to position 87; N at a position corresponding to position 86 and S at a position corresponding to position 88; N at a position corresponding to position 95 and S at a position corresponding to position 97; N at a position corresponding to position 114; N at a position corresponding to position 119 and S at a position corresponding to position 121; S at a position corresponding to position 122; N at a position corresponding to position 215 and S at a position corresponding to position 217; N at a position corresponding to position 243 and S at a position corresponding to position 245; N at a position corresponding to position 264 and S at a position corresponding to position 266; N at a position corresponding to position 293 and S at a position corresponding to position 295; N at a position corresponding to position 388; N at a position corresponding to position 389 and S at a position corresponding to position 391; N at a position corresponding to position 428 and S at a position corresponding to position 430; or N at a position corresponding to position 429 and S at a position corresponding to position 431, with reference to amino acid positions set forth in SEQ ID NO:134, or the same replacement(s) at a corresponding amino acid residue in the unmodified FX polypeptide.

For example, provided herein are modified FX polypeptides containing amino acid replacement(s) with: N at a position corresponding to position 119, S at a position corresponding to position 121, S at a position corresponding to position 196, S at a position corresponding to position 211 and H at a position corresponding to position 219; N at a position corresponding to position 114, S at a position corresponding to position 196, S at a position corresponding to position 211 and H at a position corresponding to position 219; N at a position corresponding to position 114, N at a position corresponding to position 119, S at a position corresponding to position 121, S at a position corresponding to position 196, S at a position corresponding to position 211 and H at a position corresponding to position 219; S at a position corresponding to position 196, S at a position corresponding to position 211, H at a position corresponding to position 219, N at a position corresponding to position 264 and S at a position corresponding to position 266; N at a position corresponding to position 119, S at a position corresponding to position 121, S at a position corresponding to position 196, S at a position corresponding to position 211, H at a position corresponding to position 219, N at a position corresponding to position 264 and S at a position corresponding to position 266; N at a position corresponding to position 114, S at a position corresponding to position 196, S at a position corresponding to position 211, H at a position corresponding to position 219, N at a position corresponding to position 264 and S at a position corresponding to position 266; N at a position corresponding to position 119, S at a position corresponding to position 121, S at a position corresponding to position 196, S at a position corresponding to position 211, H at a position corresponding to position 219 and N at a position corresponding to position 388; N at a position corresponding to position 114, S at a position corresponding to position 196, S at a position corresponding to position 211, H at a position corresponding to position 219 and N at a position corresponding to position 388; or S at a position corresponding to position 196, S at a position corresponding to position 211, H at a position corresponding to position 219, N at a position corresponding to position 264, S at a position corresponding to position 266 and N at a position corresponding to position 388.

Provided herein are modified FX polypeptides that contain amino acid replacement(s) that alters glycosylation by introduction of a non-native glycosylation site, while maintaining or exhibiting FVa-dependent catalytic activity. For example, provided herein are modified FX polypeptides that contain a non-native glycosylation site that is introduced by amino acid replacement(s) with: N at a position corresponding to position 51; N at a position corresponding to position 56 and S at a position corresponding to position 58; N at a position corresponding to position 62 and S at a position corresponding to position 64; N at a position corresponding to position 65 and S at a position corresponding to position 67; N at a position corresponding to position 67; N at a position corresponding to position 73 and S at a position corresponding to position 75; N at a position corresponding to position 75 and S at a position corresponding to position 77; N at a position corresponding to position 77 and S at a position corresponding to position 79; N at a position corresponding to position 78 and S at a position corresponding to position 80; S at a position corresponding to position 82; N at a position corresponding to position 83; N at a position corresponding to position 82 and S at a position corresponding to position 84; N at a position corresponding to position 85 and S at a position corresponding to position 87; N at a position corresponding to position 86 and S at a position corresponding to position 88; N at a position corresponding to position 95 and S at a position corresponding to position 97; N at a position corresponding to position 114; N at a position corresponding to position 119 and S at a position corresponding to position 121; S at a position corresponding to position 122; N at a position corresponding to position 215 and S at a position corresponding to position 217; N at a position corresponding to position 243 and S at a position corresponding to position 245; N at a position corresponding to position 264 and S at a position corresponding to position 266; N at a position corresponding to position 293 and S at a position corresponding to position 295; N at a position corresponding to position 388; N at a position corresponding to position 389 and S at a position corresponding to position 391; N at a position corresponding to position 428 and S at a position corresponding to position 430; or N at a position corresponding to position 429 and S at a position corresponding to position 431, with reference to amino acid positions set forth in SEQ ID NO:134, or the same replacement(s) at a corresponding amino acid residue in the unmodified FX polypeptide.

Among modified FX polypeptides, including any isolated or substantially purified forms, provided herein include those containing only one, two, three, four, five, six, seven, eight, nine, ten, eleven, twelve, thirteen, fourteen, fifteen, sixteen, seventeen, eighteen, nineteen, or twenty amino acid replacement(s). In one example, provided herein is a modified FX polypeptide that has a sequence of amino acids set forth in any of SEQ ID NOS: 164, 173, 174, 176, 177, 179-181, 183-190, 192-203, 205-209, 213, 259-261 and 263-265 or a sequence of amino acids that exhibits at least 75% sequence identity to any of the sequence of amino acids set forth in any of SEQ ID NOS: 164, 173, 174, 176, 177, 179-181, 183-190, 192-203, 205-209, 213, 259-261 and 263-265 and that contains the amino acid replacement(s). In another example, provided herein is a modified FX polypeptide that has a sequence of amino acids containing a light chain having the sequence of amino acids set forth as residues 1-139 and a heavy chain containing the sequence of amino acids set forth as residues 143-448 of any of SEQ ID NOS: 164, 173, 174, 176, 177, 179-181, 183-190, 192-203, 205-209, 213, 259-261 and 263-265, or a sequence of amino acids that exhibits at least 75% sequence identity to any of the sequence of amino acids containing a light chain having the sequence of amino acids set forth as residues 1-139 and a heavy chain having the sequence of amino acids set forth as residues 143-448 of any of SEQ ID NOS: 164, 173, 174, 176, 177, 179-181, 183-190, 192-203, 205-209, 213, 259-261 and 263-265 and that contains the amino acid replacement(s). In a further example, provided herein is a modified FX polypeptide that has a sequence of amino acids containing a light chain having the sequence of amino acids set forth as residues 1-139 and a heavy chain having the sequence of amino acids set forth as residues 195-448 of any of SEQ ID NOS: 164, 173, 174, 176, 177, 179-181, 183-190, 192-203, 205-209, 213, 259-261 and 263-265, or a sequence of amino acids that exhibits at least 75% sequence identity to any of the sequence of amino acids containing a light chain having the sequence of amino acids set forth as residues 1-139 and a heavy chain having the sequence of amino acids set forth as residues 195-448 of any of SEQ ID NOS: 164, 173, 174, 176, 177, 179-181, 183-190, 192-203, 205-209, 213, 259-261 and 263-265 and that contains the amino acid replacement(s). In an additional example, provided herein is a modified FX polypeptide that is a catalytically active form of any of the above polypeptides and that includes the amino acid replacement(s) and exhibits catalytic activity.

In any of the examples provided herein, modified FX polypeptides include those that, when in FXa form or catalytically active fragment thereof, exhibit increased FVa cofactor dependence compared to the same FXa polypeptide, but not containing the amino acid replacement(s). For example, the co-factor dependence is increased by at least 2-fold, 3-fold, 4-fold, 5-fold, 6-fold, 7-fold, 8-fold, 9-fold, 10-fold, 20-fold, 30-fold, 40-fold, 50-fold, 100-fold, 200-fold, 300-fold, 400-fold, 500-fold, 600-fold, 700-fold, 800-fold, 900-fold, 1000-fold, 1200-fold or 1500-fold.

In any of the examples provided herein, modified FX polypeptides include those that, wherein in active FX (FXa) form or catablyitically active fragment thereof, exhibits increased resistance to inhibitor, such as antithrombin III (AT-III) or TFPI, compared to the same FXa polypeptide, but not containing the amino acid replacement(s). The inhibitor resistance is increased at least 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold, 1500-fold, 2000-fold, 2500-fold, 3000-fold, 3500-fold, 4000-fold, 4500-fold, 5000-fold, 5500-fold or 6000-fold.

In any of the examples provided herein, modified FX polypeptides include those that, wherein in active FX (FXa) form or catablyitically active fragment thereof, exhibits at least 20%, 30%, 40%, 50%, 60%, 70%, 80%, 90%, 100%, 110%, 120%, 130%, 140%, 150%, 160%, 170%, 180%, 190% or more catalytic activity of the same FXa, but not containing the amino acid replacement(s). In one example, the catalytic activity is in the presence of FVa. In another example, the catalytic activity is in the absence of FVa.

In any of the examples of modified FX polypeptides or isolated modified FX polypeptides provided herein, the modified FX polypeptide can further contain an amino acid replacement with leucine (L) at a position corresponding to position 195 with reference to amino acid positions set forth in SEQ ID NO:134, or the same replacement(s) at a corresponding amino acid residue in the unmodified FX polypeptide.

In any of the examples of modified FX polypeptides or isolated modified FX polypeptides provided herein, the modified polypeptide can be a human polypeptide or can be a non-human polypeptide. In some examples, the modified FX polypeptide is a zymogen polypeptide. In other examples, the modified FX polypeptide is active or is activated, for example, the modified FX polypeptide lacks or does not contain an activation peptide in the heavy chain. In such examples, activation can effected by proteolytic cleavage by TF/FVIIa or FVIIIa/FIXa tenase complexes or Russell's Viper Venom FX Activator. In some examples, the modified FX polypeptide is a two-chain polypeptide. In other examples, the modified FX polypeptide is a single-chain polypeptide.

In examples of modified FX polypeptides or isolated modified FX polypeptides provided herein, only the primary sequence is modified. In other examples of any modified FX polypeptides or isolated modified FX polypeptides provided herein, the polypeptide can further contain a chemical modification or a post-translational modification. For example, the modified FX polypeptide is glycosylated, carboxylated, hydroxylated, sulfated, phosphorylated, albuminated, or conjugated to a polyethylene glycol (PEG) moiety. In additional examples of modified FX polypeptides or isolated modified FX polypeptides provided herein, the polypeptide is a chimeric or fusion protein.

Provided herein are nucleic acid molecules that contain a sequence of nucleotides encoding any of the modified FX polypeptides provided herein, including any described above or elsewhere herein. Also provided herein are vectors containing such nucleic acid molecules. The vector can be a prokaryotic vector, viral vector, or a eukaryotic vector. The vector can be a mammalian vector. In examples where the vector is a viral vector it can be an adenovirus, an adenoassociated-virus, a retrovirus, a herpes virus, a lentivirus, a poxvirus, or a cytomegalovirus vector.

Also provided herein are isolated cells containing any of the above nucleic acid molecules or vectors. The cell can be a eukaryotic cell, for example, a mammalian cell. The mammalian cell can be a baby hamster kidney cells (BHK-21) or 293 cells or CHO cells. The cell can expresses the modified FX polypeptide. Hence, also provided herein are modified FX polypeptides that are produced by cells provided herein.

Provided herein are pharmaceutical compositions containing any of the modified FX polypeptides provided herein, nucleic acids provided herein or vectors provided herein in a pharmaceutically acceptable vehicle. The pharmaceutical composition can be formulated for local, systemic or topical administration. For example, the formulation is formulated for oral, nasal, pulmonary buccal, transdermal, subcutaneous, intraduodenal, enteral, parenteral, intravenous, or intramuscular administration. In some examples, the pharmaceutical composition can be a composition formulated for controlled-release. In other examples, the pharmaceutical compositions is formulated for single-dosage administration. Compositions provided herein include any in which the modified FX polypeptide containing amino acid replacement(s) that is an active FXa and does not comprise the activation polypeptide. The compositions can be a pharmaceutical composition.

Provided herein are methods of generating a modified active Factor X (FXa) polypeptide by a) providing a composition containing a modified FX zymogen that contains a light chain having the sequence of amino acids 1-139 set forth in SEQ ID NO:134, or a sequence of amino acids that exhibits at least 75% sequence identity to the sequence of amino acids 1-139 of any of SEQ ID NOS:134 and that contains the amino acid replacement(s) and a heavy chain having the sequence of amino acids 143-448 of any of SEQ ID NOS:136-265, or a sequence of amino acids that exhibits at least 75% sequence identity to the sequence of amino acids 143-448 of any of SEQ ID NOS:136-265 and that contains amino acid replacement(s) compared to an unmodified FX polypeptide; and b) removing the activation peptide from by polypeptide by activation cleavage of the zymogen, thereby generating a modified FXa polypeptide. The FX zymogen used in the methods includes modified FX zymogens that are produced by expression of a nucleic acid encoding a polypeptide set forth in any of SEQ ID NOS: 4-133 or 136-265 and 417-546, or a nucleic acid encoding a polypeptide having a sequence of amino acids that has at least 75% sequence identity to any of SEQ ID NOS:4-133 or 136-265 and 417-546 and that contains an amino acid replacement(s) compared to an unmodified FX polypeptide. In the methods provided herein, activation cleavage by removal of the activation peptide can be effected in vivo or in vitro. For example, activation cleavage can be effected by an activator selected from among TF/FVIIa or FVIIIa/FIXa tenase complexes or Russell's Viper Venom FX Activator. The methods provided herein can include a step of removing the activator from the composition. The methods herein also can include a step of removing the activation peptide from the composition.

Provided herein are methods of treating a disease or condition that is a bleeding disorder by administering to a subject any of the modified FX polypeptide provided herein or any of the pharmaceutical compositions provided herein. The modified FX polypeptide used in the method can be a zymogen, FXa or catalytically active portion thereof that contains the amino acid replacement(s). In the methods herein, treatment with the polypeptide or the pharmaceutical composition ameliorates or alleviates the symptoms associated with the disease or condition. The methods provided herein also include monitoring the subject for changes in the symptoms associated with the bleeding disorder.

In any of the methods provided herein of treating a bleeding disorder, the bleeding disorder is a congenital bleeding disorder or an acquired bleeding disorder. For example, the bleeding disorder can be a disorder due to a deficiency of a coagulation factor, a disorder due to the presence of acquired inhibitors to a coagulation factor, a hematologic disorder, a hemorrhagic disorder, Von Willebrands' disease, a disorder that results from anticoagulant therapy with a vitamin-K antagonist, hereditary platelet disorders, vitamin K epoxide reductase Cl deficiency, gamma-carboxylase deficiency, bleeding associated with trauma, injury, thrombosis, thrombocytopenia, stoke, coagulopathy, disseminated intravascular coagulation (DIC), Bernard Soulier syndrome, Glanzman thromblastemia or storage pool deficiency. In examples where the bleeding disorder is due to a deficiency of a coagulation factor or due to the presence of acquired inhibitors to a coagulation factor, the coagulation factor is factor VII, factor IX, factor X, factor XI, factor V, factor XII, factor H or von Willebrand factor. In examples where the bleeding disorder is due to a deficiency of a coagulation factor the coagulation factor can be factor VII, factor VIII, factor IX, factor XI. For example, the bleeding disorder is hemophilia A, hemophilia B or hemophilia C.

In examples of methods herein where the bleeding disorder is due to a deficiency of a coagulation factor, the disorder is a familial multiple coagulation factor deficiency (FMFD). In examples herein where the bleeding disorder is due to the presence of acquired inhibitors to a coagulation factor, the coagulation factor is factor VII, factor VIII, factor IX, factor X, factor XI, and factor XII. In such examples, the acquired inhibitors are autoantibodies. For example, the bleeding disorder is acquired hemophilia. In examples of methods herein where the bleeding disorder is a hereditary platelet disorder it can be Chediak-Higashi syndrome, Hermansky-Pudlak syndromes, thromboxane A2 dysfunction, Glanzmann's thrombasthenia, and Bernard-Soulier syndrome. In other examples herein, where the disorder results form anticoagulant therapy with a vitamin-K antagonist, the vitamin-K antagonist can be heparin, pentasaccharide, warfarin, small molecule antithrombotics and FXa inhibitors.

In other examples of methods herein, the disorder is thrombosis, thrombocytopenia, stroke and coagulapathy. In further examples of methods herein the bleeding disorder results from a trauma, surgery or wound. In such examples, for example, the bleeding is manifested as acute haemarthroses, chronic haemophilic arthropathy, haematomas, haematuria, central nervous system bleedings, gastrointestinal bleedings, or cerebral haemorrhage. In other examples, the bleeding is due to dental extraction. In other examples herein, where the bleeding disorder is due to surgery, the surgery is heart surgery, angioplasty, lung surgery, abdominal surgery, spinal surgery, brain surgery, vascular surgery, dental surgery, or organ transplant surgery. For example, the surgery is transplant surgery is by transplantation of bone marrow, heart, lung, pancreas, or liver.

In any of the examples herein of methods for treating a bleeding disorder, the modified FX polypeptide can exhibit increased half-life compared to the unmodified FX polypeptide. For example, the increased half-life is effected by increased resistance to AT-III or by hyperglycosylation due to glycosylation of introduced non-native glycosylation sites.

In any of the examples herein of methods for treating a bleeding disorder, the method also can include administering one or more additional coagulation factors. For example, the one or more additional coagulation factors can be plasma purified or recombinant coagulation factors, procoagulants, such as vitamin K, vitamin K derivative and protein C inhibitors, plasma, platelets, red blood cells or corticosteroids.

Also provided herein are medical uses of any of the modified FX polypeptides provided herein. In one example, provided herein are any of the modified FX polypeptides provided herein for use in in treating a bleeding disorder. In other example, provided herein are uses of a pharmaceutical composition containing any of the modified FX polypeptides provided herein in the preparation of a medicament for treatment of a bleeding disorder. In the medical uses provided herein, the modified FX polypeptide is a zymogen, FXa or catalytically active form thereof that contains the amino acid replacement(s).

In any of the uses or polypeptides for use provided herein for treating a bleeding disorder, the bleeding disorder is a congenital bleeding disorder or an acquired bleeding disorder. For example, the bleeding disorder can be a disorder due to a deficiency of a coagulation factor, a disorder due to the presence of acquired inhibitors to a coagulation factor, a hematologic disorder, a hemorrhagic disorder, Von Willebrands' disease, a disorder that results from anticoagulant therapy with a vitamin-K antagonist, hereditary platelet disorders, vitamin K epoxide reductase Cl deficiency, gamma-carboxylase deficiency, bleeding associated with trauma, injury, thrombosis, thrombocytopenia, stoke, coagulopathy, disseminated intravascular coagulation (DIC), Bernard Soulier syndrome, Glanzman thromblastemia or storage pool deficiency. In examples where the bleeding disorder is due to a deficiency of a coagulation factor or due to the presence of acquired inhibitors to a coagulation factor, the coagulation factor is factor VII, factor IX, factor X, factor XI, factor V, factor XII, factor II or von Willebrand factor. In examples where the bleeding disorder is due to a deficiency of a coagulation factor the coagulation factor can be factor VII, factor VIII, factor IX, factor XI. For example, the bleeding disorder is hemophilia A, hemophilia B or hemophilia C.

In examples the uses or polypeptides for use provided herein for treating a bleeding disorder where the bleeding disorder is due to a deficiency of a coagulation factor, the disorder is a familial multiple coagulation factor deficiency (FMFD). In examples herein where the bleeding disorder is due to the presence of acquired inhibitors to a coagulation factor, the coagulation factor is factor VII, factor VIII, factor IX, factor X, factor XI, and factor XII. In such examples, the acquired inhibitors are autoantibodies. For example, the bleeding disorder is acquired hemophilia. In examples of uses or polypeptides for use provided herein where the bleeding disorder is a hereditary platelet disorder it can be Chediak-Higashi syndrome, Hermansky-Pudlak syndromes, thromboxane A2 dysfunction, Glanzmann's thrombasthenia, and Bernard-Soulier syndrome. In other examples herein, where the disorder results form anticoagulant therapy with a vitamin-K antagonist, the vitamin-K antagonist can be heparin, pentasaccharide, warfarin, small molecule antithrombotics and FXa inhibitors.

In other examples of the uses or polypeptides for use provided herein for treating a bleeding disorder, the disorder is thrombosis, thrombocytopenia, stroke and coagulapathy. In further examples, the bleeding disorder results from a trauma, surgery or wound. In such examples, for example, the bleeding is manifested as acute haemarthroses, chronic haemophilic arthropathy, haematomas, haematuria, central nervous system bleedings, gastrointestinal bleedings, or cerebral haemorrhage. In other examples, the bleeding is due to dental extraction. In other examples herein, where the bleeding disorder is due to surgery, the surgery is heart surgery, angioplasty, lung surgery, abdominal surgery, spinal surgery, brain surgery, vascular surgery, dental surgery, or organ transplant surgery. For example, the surgery is transplant surgery is by transplantation of bone marrow, heart, lung, pancreas, or liver.

In any of the examples herein of the uses or polypeptides for use provided herein for treating a bleeding disorder, the modified FX polypeptide can exhibit increased half-life compared to the unmodified FX polypeptide. For example, the increased half-life is effected by increased resistance to AT-III or by hyperglycosylation due to glycosylation of introduced non-native glycosylation sites.

Provided herein is an article of manufacture containing a packaging material and any of the pharmaceutical compositions containing any of the modified FX polypeptides provided herein contained within the packaging material. In examples of the article of manufacture provided herein, the modified FX polypeptide is effective for treatment of a bleeding disorder, and the packaging material includes a label that indicates that the modified FX polypeptide is used for treatment of a bleeding disorder. Also provided herein is a kit, containing any of the pharmaceutical compositions herein, a device for administration of the composition and, optionally, instructions for administration.

With reference to the mature human zymogen set forth in SEQ ID NO:134, the light chain is 130 amino acids (corresponding to residues 1-139 of SEQ ID NO: 134) and the heavy chain is 306 amino acids (corresponding to residues 143-448 of SEQ ID NO: 134). The light chain contains a γ-carboxyglutamic acid (GLA)-rich domain (corresponding to residues 1-39 of SEQ ID NO: 134), followed by a short hydrophobic stack (corresponding to residues 40-45 of SEQ ID NO: 134) and two epidermal growth factor (EGF)-like domains: EGF 1 (corresponding to amino acids 46-84 of SEQ ID NO:134) and EGF2 (corresponding to amino acids 85-128 of SEQ ID NO:134). The heavy chain contains a 52 amino acid residue activation at the amino terminus of the heavy chain. The heavy chain also contains the catalytic domain beginning with residue corresponding to Ile 195 of SEQ ID NO:134. The light and heavy chains of FX remain linked by a disulfide bond between Cys132 (of the light chain) and Cys302 (of the heavy chain) with reference to amino acid residues set forth in SEQ ID NO: 134.

The active Factor X (FXa) form of FX contains the structural features of the Factor X zymogen form, except that the heavy chain portion lacks the activation peptide and thus contains only the catalytic domain (also called the chymotrypsin-like serine protease domain; corresponding to residues 195-448 of SEQ ID NO:134) beginning at the new N-terminus corresponding to hydrophobic residues Ile 195-G198 in mature Factor X set forth in SEQ ID NO: 134. The conformation of FXa also differs from the FX zymogen due to the formation of a salt bridge between the α-NH2 group of Ile 195 and Asp378 in the interior of the catalytic domain corresponding to residues set forth in SEQ ID NO:134. Salt bridge formation is associated with numerous changes in catalytic domain structure including rearrangements of the activation domains, formation of the oxyanion hole required for catalysis and the formation of a substrate binding site (S1-S4).

Residues in exosite regions that contribute to extended substrate specificity also are exposed. Catalytic residues His236, Asp282, and Ser379 make up the active-site catalytic triad of the active protease. The conformational change that reorders residues also exposes heparin binding residues that bind heparin and facilitates recognition by the inhibitor AT-III.

Figure 2A:
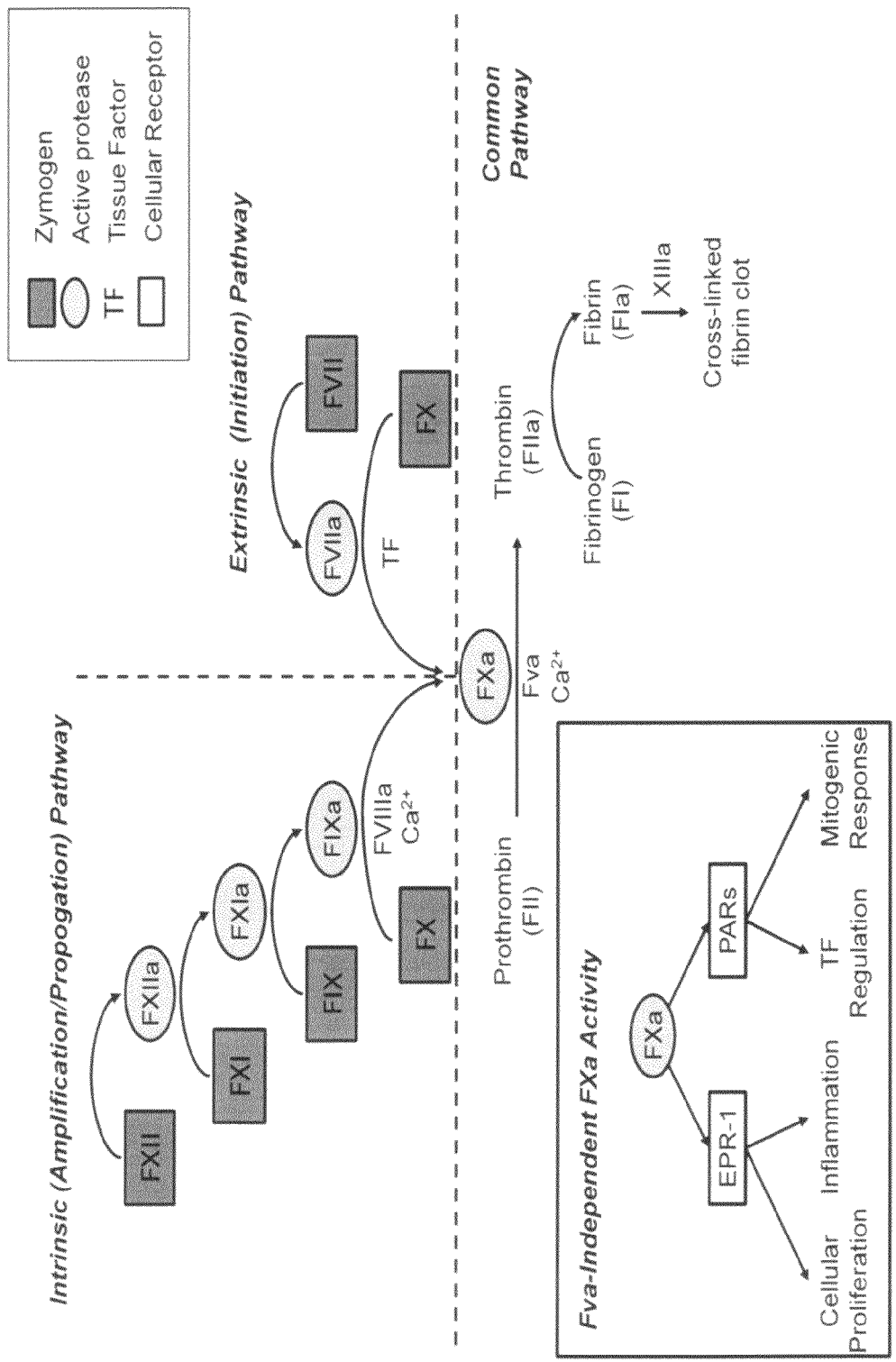
Figure 2B:
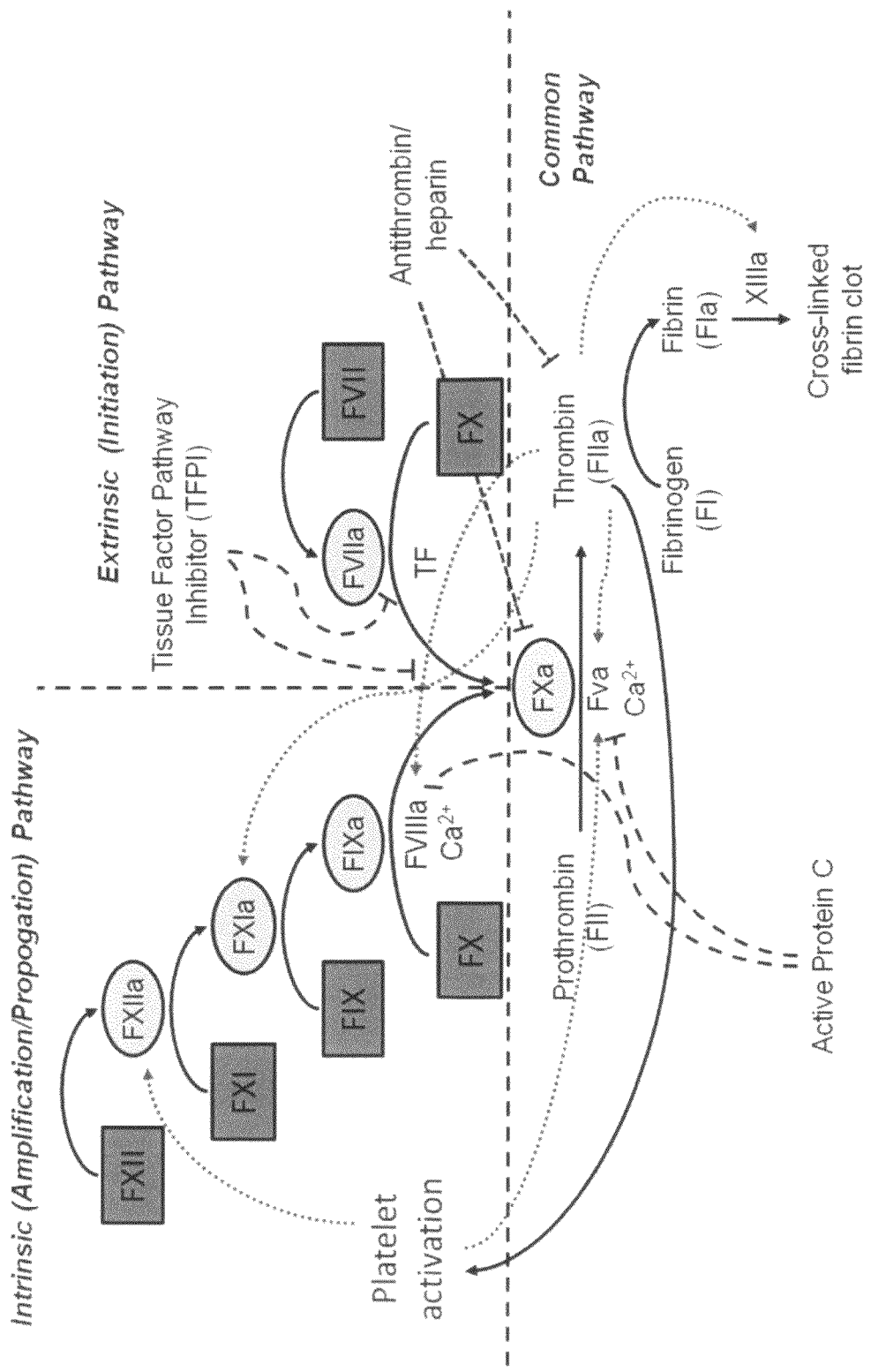

FIG. 2 (A-B) depicts the coagulation cascade. FIG. 2A shows the intrinsic pathway and the extrinsic pathway of coagulation for the independent production of FXa and convergence of the pathways to a common pathway to generate thrombin and fibrin for the formation of a clot. These pathways are interconnected. The figure depicts the order of molecules involved in the activation cascade in which a zymogen is converted to an activated protease by cleavage of one or more peptide bonds. The activated protease then serves as the activating protease for the next zymogen molecule in the cascade, ultimately resulting in clot formation. The Figure shows that the activity of FXa is regulated by the presence of FVa for the ultimate generation of thrombin and fibrin (FVa-dependent activity). FXa alone is also capable of low levels of thrombin activation (FVa-independent activity). FIG. 2A further depicts other FXa activities outside of the coagulation pathway that can be effected independent of FVa. FIG. 2B depicts the same pathway, but further depicts regulators of the pathway, including antithrombin (AT-III), that can inhibit coagulation.

FIG. 3 (A-K) depicts exemplary alignments of mature human FX set forth in SEQ ID NO:134 with other FX polypeptides. A "*" means that the aligned residues are identical, a ":" means that aligned residues are not identical, but are similar and contain conservative amino acids residues at the aligned position, and a "." means that the aligned residues are similar and contain semi-conservative amino acid residues at the aligned position. Exemplary, non-limiting, corresponding positions for amino acid replacements are indicated by highlighting. For example, FIG. 3A depicts the alignment of a mature FX set forth in SEQ ID NO:134 with white-cheeked Gibbon set forth in SEQ ID NO:404. FIG. 3B depicts the alignment of a mature FX set forth in SEQ ID NO:134 with baboon FX set forth in SEQ ID NO:405. FIG. 3C depicts the alignment of a mature FX set forth in SEQ ID NO:134 with Rhesus monkey FX set forth in SEQ ID NO:406. FIG. 3D depicts the alignment of mature FX set forth in SEQ ID NO:134 with Dusky titi monkey FX set forth in SEQ ID NO:407. FIG. 3E depicts the alignment of a mature FX set forth in SEQ ID NO:134 with elephant FX set forth in SEQ ID NO:408. FIG. 3F depicts the alignment of a mature FX set forth in SEQ ID NO:134 with mouse FX set forth in SEQ ID NO:409. FIG. 3G depicts the alignment of a mature FX set forth in SEQ ID NO:134 with rabbit FX set forth in SEQ ID NO:410. FIG. 3H depicts the alignment of a mature FX set forth in SEQ ID NO:134 with rat FX set forth in SEQ ID NO:411. FIG. 31 depicts the alignment of a mature FX set forth in SEQ ID NO:134 with dog FX set forth in SEQ ID NO:412. FIG. 3J depicts the alignment of a mature FX set forth in SEQ ID NO:134 with a FX variant I195L set forth in SEQ ID NO:135. FIG. 3K depicts the alignment of a mature FX set forth in SEQ ID NO:134 with FX variant activation peptide (Ap) 152T set forth as amino acid residues 41-488 in SEQ ID NO:549.

DETAILED DESCRIPTION

Outline

A. Definitions
B. Hemostatis and Factor X Function
1. Coagulation Pathway
a. Tissue Factor (Extrinsic) Coagulation Pathway
b. Intrinsic Coagulation Pathway
c. Common Pathway
2. Factor V-independent activity
a. Thrombin activation
b. Inflammation and Cell Proliferation
i. Effector Cell Protease Receptor-1 (EPR-1)
ii. Protease Activated Receptors (PARs)
3. Factor X Inhibitors
C. Factor X Structure and Activation
1. Processing and Structure
2. Activation
3. Factor X and Xa as a biopharmaceutical
D. Modified Factor X Polypeptides
E. Production of Factor X Polypeptides
1. Vectors and cells
2. Expression systems
a. Prokaryotic expression
b. Yeast
c. Insects and insect cells
d. Mammalian cells
e. Plants
2. Purification
3. Fusion proteins
4. Polypeptide modifications
5. Nucleotide sequences
F. Assessing modified Factor X Activities
1. In vitro assays
2. Non-Human Animal Models
3. Clinical Assays
G. Formulations and administration
1. Formulations
a. Dosages
b. Dosage forms
2. Administration of modified FVX polypeptides
3. Administration of nucleic acids encoding modified FVX polypeptides (gene therapy)
H. Therapeutic Uses
I. Combination Therapies
J. Articles of Manufacture and Kits
K. EXAMPLES

A. Definitions

Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the interne. Reference thereto evidences the availability and public dissemination of such information.

As used herein, coagulation pathway or coagulation cascade refers to the series of activation events that leads to the formation of an insoluble fibrin clot. In the coagulation cascade or pathway, an inactive protein of a serine protease (also called a zymogen) is converted to an active protease by cleavage of one or more peptide bonds, which then serves as the activating protease for the next zymogen molecule in the cascade. In the final proteolytic step of the cascade, fibrinogen is proteolytically cleaved by thrombin to fibrin, which is then crosslinked at the site of injury to form a clot.

As used herein, "hemostasis" refers to the stopping of bleeding or blood flow in an organ or body part. The term hemostasis can encompass the entire process of blood clotting to prevent blood loss following blood vessel injury to subsequent dissolution of the blood clot following tissue repair.

As used herein, "clotting" or "coagulation" refers to the formation of an insoluble fibrin clot, or the process by which the coagulation factors of the blood interact in the coagulation cascade, ultimately resulting in the formation of an insoluble fibrin clot.

As used herein, a "protease" is an enzyme that catalyzes the hydrolysis of covalent peptidic bonds. These designations include zymogen forms and activated single-, two- and multiple-chain forms thereof. For clarity, reference to proteases refer to all forms. Proteases include, for example, serine proteases, cysteine proteases, aspartic proteases, threonine and metallo-proteases depending on the catalytic activity of their active site and mechanism of cleaving peptide bonds of a target substrate.

As used herein, serine proteases or serine endopeptidases refers to a class of peptidases, which are characterized by the presence of a serine residue in the active site of the enzyme. Serine proteases participate in a wide range of functions in the body, including blood clotting and inflammation, as well as functioning as digestive enzymes in prokaryotes and eukaryotes. The mechanism of cleavage by serine proteases is based on nucleophilic attack of a targeted peptidic bond by a serine. Cysteine, threonine or water molecules associated with aspartate or metals also can play this role. Aligned side chains of serine, histidine and aspartate form a catalytic triad common to most serine proteases. The active site of serine proteases is shaped as a cleft where the polypeptide substrate binds.

As used herein, Factor X (FX) or FX polypeptide refers to a serine protease polypeptide that exhibits catalytic activity against prothrombin (i.e. prothrombogenic activity) when in active form. FX is a serine protease that is part of the coagulation pathway, and specifically is the first serine protease in the common coagulation pathway. FX is processed in cells from a precursor polypeptide (e.g. set forth in SEQ ID NO:2) to yield a polypeptide containing a propeptide region, which is eventually cleaved to generate a mature polypeptide lacking the signal sequence and propeptide (e.g. set forth in SEQ ID NO:134). The secreted FX polypeptide is a two-chain polypeptide. FX polypeptides include inactive zymogens or active Factor X (FXa). The active FXa lacks the activation peptide. FXa is the form of FX that exhibits catalytic activity, which is increased greatly upon binding of active FX (FXa) to its cofactor Factor Va. FXa activity also is enhanced by the inclusion of $Ca^{++}$ and phospholipid. As provided herein, mutations can be introduced that result in conformational changes of a FXa form to a zymogen-like form, that when in fully active form in the presence of FVa cofactor, exhibits catalytic activity against prothrombin. Hence, reference to FX or FX polypeptides herein includes all forms, which include precursor, single single-chain and two-chain forms thereof, including mature forms, zymogen forms, FXa forms, including zymogen-like forms, or catalytically active portions thereof.

Reference to FX includes human FX polypeptides, including the precursor polypeptide set forth in SEQ ID NO:2, and to single-chain and two-chain forms thereof, including mature forms, zymogen forms, FXa forms, including zymogen-like forms, or catalytically active forms thereof. For example, the mature FX lacking the signal sequence and propeptide region is set forth in SEQ ID NO:134. The zymogen form thereof is a two-chain form containing a 130 amino acid light chain (corresponding to residues 1-139 of SEQ ID NO:134) and a 306 amino acid heavy chain (corresponding to residues 143-448 of SEQ ID NO:134). The FXa form thereof is a two-chain form containing a 130 amino acid heavy chain (corresponding to residues 1-139 of SEQ ID NO:134) and a heavy chain (corresponding to amino acid residues 194-448 of SEQ ID NO:134), or catalytically active forms thereof. As noted, FX also includes modified forms thereof, including FXa that are zymogen-like in the absence of cofactor FVa.

Reference to FX also includes variants thereof, such as allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptide set forth in SEQ ID NO: 2 or the mature form, zymogen form or FXa forms thereof. Such variants include any where the FXa form, or catalytically portion thereof, exhibits one or more FX activities including, but not limited to, FVa binding, catalytic activity, prothrombin binding, prothrombinase activity and/or coagulant activity. The activity can be reduced or increased compared to the activity of a native or wildtype Factor X. For example, FX polypeptides include polypeptides where the FXa form thereof, or a catalytically active portion, exhibits at least 20%, 30%, 40%, 50%, 60%, 70%, 90%, 90%, 100%, 110%, 120%, 130%, 140%, 150%, 160%, 170%, 180%, 190%, 200% or more the activity of a native or wildtype FXa polypeptide. Exemplary variants include species variants including, but not limited to, human (precursor prepropeptide set forth in SEQ ID NO: 2 and encoded by SEQ ID NO: 1; and mature form set forth in SEQ ID NO:134), Northern White-Cheeked Gibbon (precursor prepropeptide set forth in SEQ ID NOS: 393 and mature form set forth in SEQ ID NO:404), Olive Baboon (precursor prepropeptide set forth in SEQ ID NO:394 and mature form SEQ ID NO: 405), Rhesus Monkey (precursor prepropeptide set forth in SEQ ID NO: 395 and mature form set forth in SEQ ID NO:406), Dusky titi monkey (precursor prepropeptide set forth in SEQ ID NO: 396 and mature form set forth in SEQ ID NO:407), African elephant (precursor prepropeptide set forth in SEQ ID NO:397 and mature form set forth in SEQ ID NO:408), mouse (precursor prepropeptide set forth in SEQ ID NO: 398 and mature form set forth in SEQ ID NO:409), rabbit (precursor prepropeptide set forth in SEQ ID NO: 399 and mature form set forth in SEQ ID NO:410), rat (precursor prepropeptide set forth in SEQ ID NO: 400 and mature form set forth in SEQ ID NO:411), dog (precursor prepropeptide set forth in SEQ ID NO:401 and mature form set forth in SEQ ID NO:412), pig (precursor prepropeptide set forth in SEQ ID NO:402 and mature form set forth in SEQ ID NO:413), and bovine (precursor prepropeptide set forth in SEQ ID NO:403 and mature form set forth in SEQ ID NO:414). Exemplary variants also include allelic variants of human FX, including but not limited to, variants set forth in SEQ ID NOS:547-552 (Cargill et al. (1999) *Nat. Gen.*, 22:231-238).

As used herein, a precursor FX polypeptide refers to a non-secreted form of a FX polypeptide that contains an N-terminal signal peptide that targets the protein for secretion and a propeptide. The signal peptide is cleaved off in the endoplasmic reticulum. Exemplary of a FX precursor polypeptide is the polypeptide set forth in SEQ ID NO:2, or an allelic or species variant thereof or other variants, such as any set forth in SEQ ID NOS: 393-403 or 547-552.

As used herein, a "proregion," "propeptide," or "pro sequence," refers to a region or a segment that is cleaved to produce a mature protein. A proregion is a sequence of amino acids positioned at the amino terminus of a mature biologically active polypeptide and can be as little as a few amino acids or can be a multidomain structure. For FX polypeptides, the propeptide region is generally about 9 amino acids, but can vary (e.g. longer or shorter) depending on species. For FX, the propeptide sequence functions in post-translational modification of the protein and is cleaved prior to secretion of the protein from the cell. For example, the propeptide is the recognition element for γ-carboxylation by the vitamin K-dependent carboxylase in the endoplasmic reticulum. The reaction occurs by conversion of glutamic acid residues in the Gla domain to γ-carboxyglutamic acid (Gla). This modification is required for optimal $Ca^{2+}$-mediated activation of the zymogen in the blood. For example, The gla residues permit factor X/Xa to bind phospholipid (i.e. cell surfaces) in a calcium dependent manner, which is a requirement for assembly of the prothrombinase complex An exemplary propeptide or ororeeion corresponds to amino acids 32-40 of SEO ID NO:2.

As used herein, a propeptide form of FX is a protein that lacks the signal peptide, but retains the propeptide. For example, with exemplification to the human FX set forth in SEQ ID NO:2, the propeptide is a 9 amino acid propeptide corresponding to amino acids 32-40 of SEQ ID NO: 2. Hence, an exemplary propeptide form of FX is human FX set forth as amino acids 32-488 of SEQ ID NO:2, or variants thereof, including allelic and species variants.

As used herein, a "mature FX polypeptide" refers to a FX polypeptide that lacks a signal sequence and a propeptide sequence. The propeptide is removed by proteolytic cleavage in the trans-Golgi apparatus prior to secretion of the polypeptide. An exemplary mature FX polypeptide is set forth in SEQ ID NO:134, and also includes variants thereof such as species and allelic variants. For example, exemplary of such variants are any set forth in any of SEQ ID NOS: 404-414. The mature FX polypeptide generally refers to a single chain form of FX prior to intrachain proteolysis to generate a two-chain polypeptide.

As used herein, a zymogen refers to the two-chain inactive form of FX polypeptide that is normally present in plasma. The two-chain form is generated by intrachain cleavage to remove residues Arg140-Arg142 (corresponding to residues as set forth in SEQ ID NO:134) between the heavy and light chain, such that the light chain is cleaved from the heavy chain. This occurs during or after secretion into the circulation. The zymogen is larger than the active form because of the presence of the activation peptide at the N-terminus of the heavy chain. For FX, the zymogen contains a light chain containing a γ-carboxyglutamic acid (GLA)-rich domain, and two epidermal growth factor (EGF)-like domains. The heavy chain is linked to the light chain by a disulfide bond between amino acids (e.g. Cys 132 and Cys302 in SEQ ID NO:134). The heavy chain contains a 52 amino acid residue activation peptide at its N-terminus (e.g. amino acid residues Ser143 to Arg194 in SEQ ID NO:134). The heavy chain also contains the serine protease domain (e.g. residues Ile195 to Lys448 of SEQ ID NO:134), which contains the serine protease domain having a catalytic triad (e.g. $His^{236}$, $Asp^{282}$ and $Ser^{379}$ in SEQ ID NO:134, and corresponding to $His^{57}$, $Asp^{102}$ and $Ser^{195}$ by chymotrypsin numbering). The zymogen form generally is inactive and can be converted to an active polypeptide by catalytic cleavage to remove the activation peptide segment. A zymogen, thus, is an enzymatically inactive protein that is converted to a proteolytic enzyme by the action of an activator.

As used herein, an activation peptide refers to a segment present at the N-terminus of the FX heavy chain that functions to suppress proteolytic activity by masking the catalytic machinery and thus preventing formation of the catalytic intermediate (i.e., by conformationally occluding the substrate binding site). Exemplary of a FX activation peptide is the 52 amino acid residue activation peptide at the N-terminus of the heavy chain of the mature FX polypeptide corresponding to amino acid residues Ser143 to Arg194 in SEQ ID NO:134. As used herein, a modified activation peptide refers to an activation peptide that is not native to the FX polypeptide, for example, due to the presence of one or more amino acid differences compared to the activation peptide of an unmodified factor X polypeptide or native factor X polypeptide. The one or more amino acid differences can be amino acid mutations such as one or more amino acid replacements (substitutions), insertions or deletions, or can be insertions or deletions, and any combinations thereof. For example, a modified activation peptide is one that has can have 1, 2, 3, 4, 5, 6, 7, 8, 9, 10, 11, 12, 13, 14, 15, 16, 17, 18, 19, 20, 30, 40, 50 or more amino acid differences compared to the activation peptide of an unmodified or native FX polypeptide (e.g. compared to the sequence of amino acid residues set forth as Ser143 to Arg194 in SEQ ID NO:134). Exemplary of amino acid modifications are modifications that result in a protease processing site that is not present in the unmodified or native (e.g. wildtype) FX polypeptide. For example, modifications include replacement of a native or wildtype FX polypeptide with a heterologous activation peptide from another protease.

As used herein, reference to a modified FX polypeptide that does not contain a modified activation peptide means that the activation peptide of the polypeptide does not differ compared to the activation peptide of an unmodified factor X polypeptide or native factor X polypeptide. For example, in embodiments where the modified FX polypeptide includes an activation peptide, it contains a native or wildtype activation peptide. Hence, reference to a modified FX polypeptide herein that does not contain a modified activation peptide means that modifications (e.g. amino acid replacements) therein are in the light chain or the protease domain of the heavy chain only, and typically only in the protease domain of the heavy chain.

As used herein, an active FX (FXa) or activated FX refers to a two-chain form of a FX polypeptide, whereby the heavy chain does not contain an N-terminal activation peptide. FXa is activated by cleavage of the heavy chain to remove the activation peptide. Hence, FXa is a heterodimer that is composed of 2 chains joined by a disulfide bond. For human FX, the light chain has a molecular weight of about 16,000 daltons and is composed of the sequence of amino acids 1-139 of SEQ ID NO:134, and heavy chain has a molecular weight of about 38,000 daltons and is composed of amino acid residues Ile 195 to Lys448 of SEQ ID NO:134 that make up the serine protease domain. Activation of FX occurs by cleavage of the Arg 194-Ile195 bond, which releases the activation peptide. Activation is achieved by the extrinsic Factor Xase complex (factor VIIa/TF complex) or the intrinsic Factor Xase complex (FIXa/FVIIIa complex). Activation generally requires the presence of phospholipid and calcium ions. Activation also can be achieved by Russell's viper venom (RVV-X). FXa exhibits catalytic activity, FVa binding, heparin binding, prothrombin binding, prothrombinase activity and/or coagulant activity. For purposes herein, reference to FXa refers to any FX two-chain form that lacks the activation peptide and that is capable of exhibiting FXa activities such as catalytic activity, FVa binding, heparin binding, prothrombin binding, prothrombinase activity and/or coagulant activity. Hence, reference to FXa includes zymogen-like FXa polypeptides that, in the presence of saturating concentrations of FVa, exhibit FXa activities.

As used herein, a "catalytically active portion" of a FXa polypeptide refers to an active FXa polypeptide that contains a contiguous portion of amino acids of the heavy chain that includes the catalytic triad residues (e.g. $His^{236}$, $Asp^{282}$ and $Ser^{379}$ in SEQ ID NO:134, and corresponding to $His^{57}$, $Asp^{102}$ and $Ser^{195}$ by chymotrypsin numbering), but does not include the full-sequence of the heavy chain corresponding to amino acid residues Ile195 to Lys448 of SEQ ID NO:134. The catalytically active portion also can contain all or a portion of the light chain of FXa. The catalytically active portion of a FXa polypeptide exhibits at least 1%, 2%, 3%, 4%, 5%, 6%, 7%, 8%, 9%, 10%, 20%, 30%, 40%, 50%, 60%, 70%, 80%, 90%, or more of the activity, such as at least 120%, 130%, 140%, 150%, 200%, 300%, 400%, 500% or more of the activity, compared to the full-length FXa. It is understood that reference herein to a modified FXa or catalytically active portion thereof means that the catalytically active portion contains the modification(s) (e.g. amino acid replacement(s)).

As used herein, Russell's viper venom (RVV-X) refers to a venom metalloprotease of *Vipera russelli* (Russell's viper) that specifically activates factor X (Takeya et al. (1992) *J Biol. Chem.*, 267:14109-14117). RVV-X has a molecular weight of about 79,000 daltons and contains a disulfide bonded heavy and light chain. RVV-X does not require phospholipids for factor X activation, but does require exogenous $Ca^{2+}$ and the presence of the amino terminal Gla domain for enhanced activation. The activity of RVV-X is inhibited in the presence of EDTA. Purified preparations of the snake venom protease are known and available (see e.g. Catalog No. RVVX-2010, Haematologic Technologies, Inc.; Catalog No. ab62233; Abcam, Cambridge, Mass.), and its sequence known (see e.g. Takeya et al. (1992) *J Biol. Chem.*, 267:14109-14117 and Uniprot No. Q7LZ61, Q4PRD1 and Q4PRD2).

As used herein, a "zymogen-like" protein or polypeptide refers to a protein that has been activated by proteolytic cleavage, but in the absence of cofactor still exhibits properties that are associated with a zymogen, such as, for example, low or no activity, or a conformation or resulting activity that resembles the conformation or resulting activity of the zymogen form of the protein. For example, for the modified FXa polypeptides provided herein, when not bound to the FVa co-factor, the two-chain activated form of FXa is a zymogen-like protein; it exhibits very low activity. Upon binding to FVa, the two-chain activated form of FXa undergoes a conformational change or a shift in "conformational equilibrium" and acquires its full activity as a coagulation factor.

As used herein, wild-type" or "native" with reference to FX refers to a FX polypeptide encoded by a native or naturally occurring FX gene, including allelic variants, that is present in an organism, including a human and other animals, in nature. Where reference is made to a wildtype or native FXa polypeptide, it is understood that this is the active or catalytically active portion of the FXa polypeptide. Reference to wild-type factor X without reference to a species is intended to encompass any species of a wild-type factor X. Included among wild-type FX polypeptides are the encoded precursor polypeptide, fragments thereof, and processed forms thereof, such as a mature form lacking the signal peptide and propeptide, as well as any pre- or post-translationally processed or modified forms thereof. Also included among native FX polypeptides are those that are post-translationally modified, including, but not limited to, modification by glycosylation, carboxylation and hydroxylation. Native FX polypeptides also include two-chain secreted forms, including the zymogen and active forms, as well as any processed forms or isoforms thereof. For example, humans express native FX. The amino acid sequence of wild-type human FX is set forth in SEQ ID NOS: 2, and includes mature, zymogen, active and catalytically active forms thereof as described herein, and allelic variants set forth in SEQ ID NOS: 547-552 and the mature, zymogen, active and catalytically active forms thereof. Northern White-Cheeked Gibbon (precursor prepropeptide set forth in SEQ ID NOS: 393 and mature form set forth in SEQ ID NO:404), Olive Baboon (precursor prepropeptide set forth in SEQ ID NO:394 and mature form SEQ ID NO: 405), Rhesus Monkey (precursor prepropeptide set forth in SEQ ID NO: 395 and mature form set forth in SEQ ID NO:406), Dusky titi monkey (precursor prepropeptide set forth in SEQ ID NO: 396 and mature form set forth in SEQ ID NO:407), African elephant (precursor prepropeptide set forth in SEQ ID NO:397 and mature form set forth in SEQ ID NO:408), mouse (precursor prepropeptide set forth in SEQ ID NO: 398 and mature form set forth in SEQ ID NO:409), rabbit (precursor prepropeptide set forth in SEQ ID NO: 399 and mature form set forth in SEQ ID NO:410), rat (precursor prepropeptide set forth in SEQ ID NO: 400 and mature form set forth in SEQ ID NO:411), dog (precursor prepropeptide set forth in SEQ ID NO:401 and mature form set forth in SEQ ID NO:412), pig (precursor prepropeptide set forth in SEQ ID NO:402 and mature form set forth in SEQ ID NO:413), and bovine (precursor prepropeptide set forth in SEQ ID NO:403 and mature form set forth in SEQ ID NO:414).

As used herein, species variants refer to variants in polypeptides among different species, including different mammalian species, such as mouse and human.

As used herein, allelic variants refer to variations in proteins among members of the same species.

As used herein, a splice variant refers to a variant produced by differential processing of a primary transcript of genomic DNA that results in more than one type of mRNA.

As used herein, corresponding residues refers to residues that occur at aligned loci. Related or variant polypeptides are aligned by any method known to those of skill in the art. Such methods typically maximize matches, and include methods such as using manual alignments and by using the numerous alignment programs available (for example, BLASTP) and others known to those of skill in the art. By aligning the sequences of FX polypeptides, one of skill in the art can identify corresponding residues, using conserved and identical amino acid residues as guides. Generally, recitation that amino acids of a polypeptide correspond to amino acids in a disclosed sequence refers to amino acids identified upon alignment of the polypeptide with the disclosed sequence to maximize identity or homology (where conserved amino acids are aligned) using a standard alignment algorithm, such as the GAP algorithm. For example, with reference to alignments set forth in FIGS. 3A-3K, amino acid residue His8 in the light chain of mature human FX set forth in SEQ ID NO:134 corresponds to Asn8 in white-cheeked baboon set forth in SEQ ID NO:404. In another example, Asp 164 in the heavy chain of mature human FX set forth in SEQ ID NO:134 corresponds to Asp161 in the rat FX set forth in SEQ ID NO: 411.

As used herein, domain (typically a sequence of three or more, generally 5 or 7 or more amino acids) refers to a portion of a molecule, such as proteins or the encoding nucleic acids, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as proteolytic activity. A protein can have one, or more than one, distinct domains. For example, a domain can be identified, defined or distinguished by homology of the sequence therein to related family members, such as homology to motifs that define a protease domain or a gla domain. In another example, a domain can be distinguished by its function, such as by proteolytic activity, or an ability to interact with a biomolecule, such as DNA binding, ligand binding, and dimerization. A domain independently can exhibit a biological function or activity such that the domain independently or fused to another molecule can perform an activity, such as, for example proteolytic activity or ligand binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed appropriate software can be employed to identify domains.

As used herein, a protease domain or a catalytically active domain is the domain that confers catalytic activity. Reference to a protease domain of a protease includes the single, two- and multi-chain forms of any of these proteins. A protease domain of a protein contains all of the requisite properties of that protein required for its proteolytic activity, such as for example, the catalytic center. In reference to FX, the protease domain shares homology and structural feature with the chymotrypsin/trypsin family protease domains, including the catalytic triad. For example, in the FX polypeptide set forth in SEQ ID NO:134, the protease domain corresponds to amino acid positions Ile195 to Lys448 of SEQ ID NO:134 and includes the catalytic triad residues (e.g. $His^{236}$, $Asp^{282}$ and $Ser^{379}$ in SEQ ID NO:134, and corresponding to $His^{57}$, $Asp^{102}$ and $Ser^{195}$ by chymotrypsin numbering).

As used herein, a gamma-carboxyglutamate (Gla) domain refers to the portion of a protein, for example a vitamin K-dependent protein, that contains post-translational modifications of glutamate residues; generally most, but not all of the glutamate residues, by vitamin K-dependent carboxylation to form Gla. The Gla domain is responsible for the high-affinity binding of calcium ions and binding to negatively-charged phospholipids. Typically, the Gla domain starts at the N-terminal extremity of the mature form of vitamin K-dependent proteins and ends with a conserved aromatic residue. Upon cleavage to two-chains, the Gla domain is in the light chain. With reference to mature FX, the Gla domain corresponds to amino acid positions 1 to 39 of the exemplary polypeptide set forth in SEQ ID NO:134. Gla domains are well known and their locus can be identified in particular polypeptides. The Gla domains of the various vitamin K-dependent proteins share sequence, structural and functional homology, including the clustering of N-terminal hydrophobic residues into a hydrophobic patch that mediates interaction with negatively charged phospholipids on the cell surface membrane. Exemplary other Gla-containing polypeptides include, but are not limited to, FIX, FVII, prothrombin, protein C, protein S, osteocalcin, matrix Gla protein, Growth-arrest-specific protein 6 (Gas6), and protein Z.

As used herein, an epidermal growth factor (EGF) domain (EGF-1 or EGF-2) refers to the portion of a protein that shares sequence homology to a specific 30 to 40 amino acid portion of the epidermal growth factor (EGF) sequence. The EGF domain includes six cysteine residues that have been shown (in EGF) to be involved in disulfide bonds. The main structure of an EGF domain is a two-stranded beta-sheet followed by a loop to a C-terminal short two-stranded sheet. FX contains two EGF domains: EGF-1 and EGF-2. These domains correspond to amino acid positions 46-84, and 85-128, respectively, of the mature FX polypeptide set forth in SEQ ID NO:134. When cleaved to two-chain form, the EGF domains are in the light chain.

As used herein, "unmodified polypeptide" or "unmodified FX" and grammatical variations thereof refer to a starting polypeptide that is selected for modification as provided herein. The starting polypeptide can be a naturally-occurring, wild-type form of a polypeptide. Exemplary of an unmodified FX polypeptide is human FX set forth in SEQ ID NO:134, and zymogen or FXa two-chain forms thereof. In addition, the starting polypeptide can be altered or mutated, such that it differs from a native wild type isoform but is nonetheless referred to herein as a starting unmodified polypeptide relative to the subsequently modified polypeptides produced herein. Thus, existing proteins known in the art that have been modified to have a desired increase or decrease in a particular activity or property compared to an unmodified reference protein can be selected and used as the starting unmodified polypeptide. For example, a protein that has been modified from its native form by one or more single amino acid changes and possesses either an increase or decrease in a desired property, such as a change in a amino acid residue or residues to alter glycosylation, can be a target protein, referred to herein as unmodified, for further modification of either the same or a different property.

As used herein, "modified factor X polypeptides" and "modified factor X" refer to a FX polypeptides, including any form thereof such as FX zymogen or FXa, that has one or more amino acid differences compared to an unmodified factor X polypeptide. The one or more amino acid differences can be amino acid mutations such as one or more amino acid replacements (substitutions), insertions or deletions, or can be insertions or deletions of entire domains, and any combinations thereof. Typically, a modified FX polypeptide has one or more modifications in primary sequence compared to an unmodified FX polypeptide. For example, a modified FX polypeptide provided herein can have 1, 2, 3, 4, 5, 6, 7, 8, 9, 10, 11, 12, 13, 14, 15, 16, 17, 18, 19, 20, 30, 40, 50 or more amino acid differences compared to an unmodified FX polypeptide. Any modification is contemplated as long as the resulting polypeptide exhibits at least one FX activity associated with a native FX polypeptide, such as, for example, catalytic activity, proteolytic activity, prothrombotic activity or coagulation activity.

As used herein, a "property" of a FX polypeptide refers to a physical or structural property, such as three-dimensional structure, pI, half-life, conformation and other such physical characteristics.

As used herein, an "activity" of a FX polypeptide or "FX activity" or "FXa activity" refers to any activity exhibited by the active Factor Xa form of the polypeptide. Such activities can be tested in vitro and/or in vivo and include, but are not limited to, coagulation or coagulant activity, pro-coagulant activity, proteolytic or catalytic activity such as to effect prothrombin activation; antigenicity (ability to bind to or compete with a polypeptide for binding to an anti-FX antibody); ability to bind FVa, prothrombin, heparin and/or ability to bind to phospholipids. Activity can be assessed in vitro or in vivo using recognized assays, for example, by measuring coagulation in vitro or in vivo. The results of such assays indicate that a polypeptide exhibits an activity that can be correlated to activity of the polypeptide in vivo, in which in vivo activity can be referred to as biological activity. Assays to determine functionality or activity of modified forms of FX are known to those of skill in the art. Exemplary assays to assess the activity of a FX polypeptide include prothromboplastin time (PT) assay or the activated partial thromboplastin time (aPTT) assay to assess coagulant activity, or chromogenic assays using synthetic substrates, such as described in the Examples, below, to assess catalytic or proteolytic activity.

As used herein, "exhibits at least one activity" or "retains at least one activity" refers to the FX activity exhibited by a modified FX polypeptide as compared to an unmodified FX polypeptide of the same form and under the same conditions. Generally, the activity is the activity of the FXa form of the polypeptide, or a catalytically active portion thereof. For example, an activity of a modified FXa polypeptide in a two-chain form is compared with an unmodified FXa polypeptide in a two-chain form, under the same experimental conditions, where the only difference between the two polypeptides is the modification under study. Typically, a modified FX polypeptide that retains or exhibits at least one activity of an unmodified FX polypeptide of the same form retains a sufficient amount of the activity such that, when administered in vivo, the modified FX polypeptide is therapeutically effective as a procoagulant therapeutic. A modified FX polypeptide can exhibit increased or decreased activity compared to the unmodified FX polypeptide in the same form. Generally, a modified FX polypeptide exhibits an activity if it exhibits 0.5% to 500% of the activity of the unmodified FX polypeptide, such as at least or about at least or 0.5%, 1%, 2%, 3%, 4%, 5%, 6%, 7%, 8%, 9%, 10%, 11%, 12%, 13%, 14%, 15%, 16%, 17%, 18%, 19%, 20%, 30%, 40%, 50%, 60%, 70%, 80%, 90%, 100%, 200%, 300%, 400%, 500% or more of the activity of an unmodified FX polypeptide of the same form that displays therapeutic efficacy as a procoagulant. The amount of activity that is required to maintain therapeutic efficacy as a procoagulant can be empirically determined, if necessary. Typically, retention of 0.5% to 20%, 0.5% to 10%, 0.5% to 5% of an activity is sufficient to retain therapeutic efficacy as a procoagulant in vivo. The particular level to be retained is a function of the intended use of the polypeptide and can be empirically determined. Activity can be measured, for example, using in vitro or in vivo assays such as those described herein or in the Examples below.

As used herein, "catalytic activity" or "proteolytic activity" with reference to FX refers to the ability of the FXa form, or a catalytically active portion thereof, to catalyze the proteolytic cleavage of a substrate. Assays to assess such activities are known in the art. Assays include those that monitor or assess the formation of stable acyl-enzyme intermediates with substrate, assays that assess binding to inhibitors of FXa that correlate to catalytic activity and assays that directly assess cleavage of a FXa substrate (e.g. prothrombin) or synthetic substrate. For example, the proteolytic activity of FX can be measured using chromogenic or fluorogenic substrates such as fluorescein-mono-p'-guanidinobenzoate (FMGB) or Spectrozyme FXa (Methoxycarbonyl-D-cyclohexylglycyl-gylcyl-arginine-para-nitroanilide acetate), using a tight-binding reversible inhibitor such as ecotin, or using the FXa substrate prothrombin. The assessment of catalytic activity can be direct or indirect. For example, the catalytic activity can be assessed by monitoring the cleavage of downstream activities of a FXa substrate as exemplified in Example 4 herein whereby the activity of activated thrombin for its synthetic substrate Pefafluor TH(H-D-CHA-Ala-Arg-AMC is monitored. Exemplary assays are depicted in the Examples. Assays to assess catalytic activity can be performed in the presence or absence of FVa and also in the presence or absence of phospholipids or $Ca^{2+}$. Catalytic activity can be represented as the catalytic efficiency or kcat/km, which is a measure of the efficiency with which a protease cleaves a substrate and is measured under steady state conditions as is well known to those skilled in the art.

As used herein, "coagulation activity" or "coagulant activity" or "pro-coagulant activity" refers to the ability of a polypeptide to effect coagulation. Assays to assess coagulant activity are known to those of skill in the art, and include prothromboplastin time (PT) assay or the activated partial thromboplastin time (aPTT) assay.

As used herein, prothrombinase activity refers to a specific catalytic activity for the substrate prothrombin and is the activity to convert prothrombin (Factor II) to thrombin (Factor IIa). The activity can be assessed directly, for example, by protein analysis of SDS-PAGE resolved products of cleavage reactions. Activity also can be assessed using synthetic substrates whereby chromogenic or fluorgenically-released moieties are monitored upon cleavage. The activity also can be assessed indirectly by monitoring the activity of thrombin for its substrate or a synthetic substrate (e.g. Pefafluor TH(H-D-CHA-Ala-Arg-AMC). Assays to assess prothrombinase activity can be performed in the presence or absence of FVa and also in the presence or absence of phospholipids or $Ca^{2+}$.

As used herein, "inhibitors of coagulation" refer to proteins or molecules that act to inhibit or prevent coagulation or clot formation. The inhibition or prevention of coagulation can be observed in vivo or in vitro, and can be assayed using any method known in the art including, but not limited to, prothromboplastin time (PT) assay or the activated partial thromboplastin time (aPTT) assay.

As used herein, antithrombin III (AT or AT-III) is a serine protease inhibitor (serpin). AT-III is synthesized as a precursor protein containing 464 amino acid residues (SEQ ID NO:553) that is cleaved during secretion to release a 432 amino acid mature antithrombin (SEQ ID NO:554).

As used herein, "inhibitory effect of AT-III" or "inhibition by AT-III" refers to the ability of antithrombin III (AT or AT-III) to inhibit the catalytic or coagulant activity of the FXa form of a FX polypeptide, or a catalytically active or zymogen-like form thereof. Inhibition by AT-III can be assayed by assessing the binding of a FX polypeptide or modified FX polypeptide to the inhibitor. Assays to determine the binding of a polypeptide to an inhibitor are known in the art. In addition, surface plasma resonance, such as on a BIAcore biosensor instrument, also can be used to measure the binding of FX polypeptides to AT-III or other inhibitors. However, for covalent inhibitors such as AT-III, only an on-rate can be measured using BIAcore. The inhibitory activity also can be assessed by assessing catalytic activity or coagulant activity of FXa in the presence of AT-III. For covalent inhibitors, such as, for example, AT-III, a second order rate constant for inhibition also can be measured. For example, inhibition by AT-III also can be assessed by determining the second-order rate constant ($k_{app}$) for inhibition of FXa. Inhibition reactions are generally performed in the presence of heparin, which is required for full activity of AT-III. For example, generally AT-III exhibits an inhibitory effect if its $K_{0.5}$ (i.e. the molar concentration of AT-III that is required for 50% inhibition of the catalytic activity of FXa) is less than 80 nM, and generally less than 70 nM, 60 nM, 50 nM, 40 nM, 30 nM, 20 nM, 10 nM, 9 nM, 8 nM, 7 nM, 6 nM, 5 nM, 4 nM, 3 nM, 2 nM or less. For example, AT-III exhibits a $K_{0.5}$ of about 2 nM for plasma FXa and wildtype FXa exhibit. In another example, AT-III exhibits an inhibitory effect if the $k_{app}$ ($M^{-1}$ $s^{-1}$) is greater than $1.0 \times 10^6$, and generally greater than that $2.0 \times 10^6$, $3.0 \times 10^6$, $4.0 \times 10^6$, $5.0 \times 10^6$, $6.0 \times 10^6$, $7.0 \times 10^6$, $8.0 \times 10^6$, $9.0 \times 10^6$, $1.0 \times 10^7$, $2.0 \times 10^7$, or more. For example, AT-III exhibits a $k_{app}$ of about $1.4 \times 10^7$ and $9.7 \times 10^6$ for plasma FXa and wildtype FXa, respectively.

As used herein, increased resistance to inhibitors, such as "increased resistance to AT-III" or "increased resistance to TFPI," refers to any amount of decreased sensitivity of a polypeptide to the inhibitory effects of an inhibitor, such as AT-III, TFPI or other inhibitor, compared with a reference polypeptide, such as an unmodified FX polypeptide. Assays to determine the inhibitory effect of an inhibitor, for example, AT-III or TFPI, on a modified FX polypeptide can be performed in the presence of the inhibitor (e.g. AT-III or TFPI) and inhibitory activity compared to the inhibitory effect of the same inhibitor (e.g. AT-III or TFPI) on a reference or unmodified FX polypeptide. For example, the ability of a modified FX polypeptide to cleave its substrate prothrombin in the presence or absence of AT-III can be measured, and the degree to which AT-III inhibits the reaction determined. This can be compared to the ability of an unmodified FX polypeptide to cleave prothrombin in the presence or absence of AT-III. Similar assays can be done with TFPI. A modified polypeptide that exhibits increased resistance to an inhibitor exhibits, for example, an increase of 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more resistance to the effects of an inhibitor compared to an unmodified polypeptide. The resistance to inhibition can be determined as a ratio of the inhibitory activity of modified FX to unmodified FX polypeptide. For example, the $K_{0.5}$ can be determined and a representation of the extent of inhibitor resistance (e.g. AT-III resistance or TFPI resistance) of the modified FX polypeptide compared to the wild-type FXa expressed as a ratio of their $K_{0.5}$ values ($K_{0.5}$ variant/$K_{0.5}$ wild-type). A ratio of greater than 1.0 means that the modified FX polypeptide exhibits increased resistance to inhibitor (e.g. AT-III or TFPI). In another example, the $k_{app}$ can be determined and a representation of the extent of inhibitor resistance (e.g. AT-III resistance or TFPI resistance) of the modified FX polypeptide compared to the wild-type FXa expressed as a ratio of their $k_{app}$ values ($k_{app}$ wild-type/$k_{app}$ variant). A ratio of greater than 1.0 means that the modified FX polypeptide exhibits increased resistance to inhibitor, such as AT-III and/or TFPI.

As used herein, cofactors refer to proteins or molecules that bind to other specific proteins or molecules to form an active complex. In some examples, binding to a cofactor is required for optimal proteolytic activity. For example, factor Va (FVa) is a cofactor of FXa. Binding of FXa or zymogen-like forms of FXa to FVa induces conformational changes that result in increased proteolytic activity of FXa for its substrates.

As used herein, Factor Va (FVa) refers to to a nonenzymatically active coagulation factor that functions as a cofactor for FXa. Factor V is a single chain polypeptide that is activated by thrombin on the surface of activated platelets to yield FVa, which is a two chain polypeptide noncovalently bound to each other by calcium. FVa binds to FXa to form the prothrombinase complex, which in the presence of phospholipids and $Ca^{2+}$, converts prothrombin to thrombin. In vivo, this generally occurs on the cell surface. FVa is a cofactor to FXa because the activity of FXa for activating thrombin is greatly increased in the presence of FVa.

As used herein, "FVa-independent activity" refers to the activity of FXa in the absence of FVa.

As used herein, "FVa-dependent activity" refers to the activity of FXa in the presence of FVa.

As used herein, "cofactor dependence" or "relative cofactor dependence" refers to the greater FXa activity that occurs in the presence of FVa compared to its absence, and can be depicted as a ratio of FVa-dependent activity to FVa-independent activity. Generally, FXa exhibits significantly greater activity in the presence of cofactor than in its absence, such that its full activity is dependent on the presence of cofactor. For example, association of active FXa with its activated cofactor, FVa, results in greater than 2,000 fold increase in activity (e.g. catalytic activity) compared to the absence of co-factor.

As used herein, increased co-factor dependence refers to any amount of increased cofactor dependence of a modified FX polypeptide compared to a reference polypeptide, such as an unmodified FX polypeptide. A modified polypeptide that exhibits increased co-factor dependence exhibits, for example, an increase of 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more increased dependence on co-factor compared to an unmodified polypeptide. The increased co-factor dependence can be determined as a ratio of the cofactor dependence (FVa-dependent activity/FVa-independent activity) of modified FX polypeptide to a reference or unmodified FX polypeptide not containing the modification(s). For example, a modified FX polypeptide exhibits increased co-factor dependence if it exhibits at least 1.5-fold, 2-fold, 3-fold, 4-fold, 5-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold or more increased co-factor dependence compared to the unmodified FX polypeptide.

As used herein, a glycosylation site refers to an amino position in a polypeptide to which a carbohydrate moiety can be attached. Typically, a glycosylated protein contains one or more amino acid residues, such as asparagine or serine, for the attachment of the carbohydrate moieties. As used herein, a native glycosylation site refers to an amino position to which a carbohydrate moiety is attached in a wild-type polypeptide. There are four native glycosylation sites in FX: two O-linked and two N-linked glycosylation corresponding to residues Thr159, Thr171, Asn181 and Asn191 with reference to SEQ ID NO:134.

As used herein, a non-native glycosylation site refers to an amino position to which a carbohydrate moiety is attached in a modified polypeptide that is not present in a wild-type polypeptide. Non-native glycosylation sites can be introduced into a FX polypeptide by amino acid replacement. O-glycosylation sites can be created, for example, by amino acid replacement of a native residue with a serine or threonine. N-glycosylation sites can be created, for example, by establishing the motif Asn-Xaa-Ser/Thr/Cys, where Xaa is not proline. Creation of this consensus sequence by amino acid modification can involve, for example, a single amino acid replacement of a native amino acid residue with an asparagine, a single amino acid replacement of a native amino acid residue with a serine, threonine or cysteine, or a double amino acid replacement involving a first amino acid replacement of a native residue with an asparagine and a second amino acid replacement of native residue with a serine, threonine or cysteine.

As used herein, "level of glycosylation" refers to the number of glycosylation sites capable of being occupied by a glycan, for example, upon expression in a host cell capable of glycosylation.

As used herein, increases with reference to the level of glycosylation means that there is a greater number of glycosylation sites capable of being occupied by a glycan with reference to an unmodified or wildtype FX polypeptide. A modified polypeptide that exhibits an increased level of glycosylation can be hyperglycosylated if there is a greater number of glycosylation sites occupied by a glycan compared to the unmodified or wildtype FX polypeptide.

As used herein, "biological activity" refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a FX polypeptide encompasses the coagulant activity.

As used herein the term "assess", and grammatical variations thereof, is intended to include quantitative and qualitative determination in the sense of obtaining an absolute value for the activity of a polypeptide, and also of obtaining an index, ratio, percentage, visual or other value indicative of the level of the activity. Assessment can be direct or indirect. For example, detection of cleavage of a substrate by a polypeptide can be by direct measurement of the product, or can be indirectly measured by determining the resulting activity of the cleaved substrate.

As used herein, "mature numbering" or "standard numbering" refers to the numbering of residues in order based on a mature FX polypeptide. For purposes herein, mature numbering is based on the numbering of residues of mature FX set forth in SEQ ID NO:134.

As used herein, "chymotrypsin numbering" refers to the numbering of amino acid residues based on the numbering of a mature chymotrypsin polypeptide of SEQ ID NO:556. Alignment of a protease domain of another serine protease, such as for example the protease domain of factor X, is made with chymotrypsin based on sequence matching patterns derived from three-dimensional modeling and overlap of structures of common serine proteases (see e.g. Greer, J., Proteins Struct. Funct. Genet. 7 (1990) 317-334). In such an instance, the amino acids of factor X that correspond to amino acids of chymotrypsin are given the numbering of the chymotrypsin amino acids. The corresponding chymotrypsin numbers of amino acid positions 195 to 448, corresponding to the protease domain of the heavy chain of the FX polypeptide set forth in SEQ ID NO:134, are provided in Table 1. The amino acid positions relative to the sequence set forth in SEQ ID NO:134 are in normal font, the amino acid residues at those positions are in bold, and the corresponding chymotrypsin numbers are in italics. For example, upon alignment of the mature factor FX (SEQ ID NO:134) with mature chymotrypsin (SEQ ID NO:556), the isoleucine (I) at amino acid position 195 in factor X is given the chymotrypsin numbering of I16. Subsequent amino acids are numbered accordingly. Where a residue exists in a protease, but is not present in chymotrypsin, the amino acid residue is given a letter notation (e.g. residue 330 by mature numbering is residue 146A by chymotrypsin numbering).

TABLE 1

| Chymotryspin numbering of Factor X | | | | | | | | | | | | | | |
|---|---|---|---|---|---|---|---|---|---|---|---|---|---|---|
| 195 | 196 | 197 | 198 | 199 | 200 | 201 | 202 | 203 | 204 | 205 | 206 | 207 | 208 | 209 |
| I | V | G | G | Q | E | C | K | D | G | E | C | P | W | Q |
| 16 | 17 | 18 | 19 | 20 | 21 | 22 | 23 | 24 | 25 | 26 | 27 | 28 | 29 | 30 |
| 210 | 211 | 212 | 213 | 214 | 215 | 216 | 217 | 218 | 219 | 220 | 221 | 222 | 223 | 224 |
| A | L | L | I | N | E | E | N | E | G | F | C | G | G | T |
| 31 | 32 | 33 | 34 | 35 | 36 | 37 | 38 | 39 | 40 | 41 | 42 | 43 | 44 | 45 |
| 225 | 226 | 227 | 228 | 229 | 230 | 231 | 232 | 233 | 234 | 235 | 236 | 237 | 238 | 239 |
| I | L | S | E | F | Y | I | L | T | A | A | H | C | L | Y |
| 46 | 47 | 48 | 49 | 50 | 51 | 52 | 53 | 54 | 55 | 56 | 57 | 58 | 59 | 60 |
| 240 | 241 | 242 | 243 | 244 | 245 | 246 | 247 | 248 | 249 | 250 | 251 | 252 | 253 | 254 |
| Q | A | K | R | F | K | V | R | V | G | D | R | N | T | E |
| 61 | 61A | 62 | 63 | 64 | 65 | 66 | 67 | 68 | 69 | 70 | 71 | 72 | 73 | 73A |
| 255 | 256 | 257 | 258 | 259 | 260 | 261 | 262 | 263 | 264 | 265 | 266 | 267 | 268 | 269 |
| Q | E | E | G | G | E | A | V | H | E | V | E | V | V | I |
| 74 | 75 | 77 | 78 | 79 | 80 | 81 | 82 | 83 | 84 | 85 | 86 | 87 | 88 | 89 |
| 270 | 271 | 272 | 273 | 274 | 275 | 276 | 277 | 278 | 279 | 280 | 281 | 282 | 283 | 284 |
| K | H | N | R | F | T | K | E | T | Y | D | F | D | I | A |
| 90 | 91 | 92 | 93 | 94 | 95 | 96 | 97 | 98 | 99 | 100 | 101 | 102 | 103 | 104 |
| 285 | 286 | 287 | 288 | 289 | 290 | 291 | 292 | 293 | 294 | 295 | 296 | 297 | 298 | 299 |
| V | L | R | L | K | T | P | I | T | F | R | M | N | V | A |
| 105 | 106 | 107 | 108 | 109 | 110 | 111 | 112 | 113 | 114 | 115 | 116 | 117 | 118 | 119 |
| 300 | 301 | 302 | 303 | 304 | 305 | 306 | 307 | 308 | 309 | 310 | 311 | 312 | 313 | 314 |
| P | A | C | L | P | E | R | D | W | A | E | S | T | L | M |
| 120 | 121 | 122 | 123 | 124 | 124A | 125 | 126 | 127 | 128 | 129 | 129A | 130 | 131 | 132 |
| 315 | 316 | 317 | 318 | 319 | 320 | 321 | 322 | 323 | 324 | 325 | 326 | 327 | 328 | 329 |
| T | Q | K | T | G | I | V | S | G | F | G | R | T | H | E |
| 133 | 133A | 134 | 135 | 136 | 137 | 138 | 139 | 140 | 141 | 142 | 143 | 144 | 145 | 146 |
| 330 | 331 | 332 | 333 | 334 | 335 | 336 | 337 | 338 | 339 | 340 | 341 | 342 | 343 | 344 |
| K | G | R | Q | S | T | R | L | K | M | L | E | V | P | Y |
| 146A | 149 | 150 | 151 | 152 | 153 | 154 | 155 | 156 | 157 | 158 | 159 | 160 | 161 | 162 |
| 345 | 346 | 347 | 348 | 349 | 350 | 351 | 352 | 353 | 354 | 355 | 356 | 357 | 358 | 359 |
| V | D | R | N | S | C | K | L | S | S | S | F | I | I | T |
| 163 | 164 | 165 | 166 | 167 | 168 | 169 | 170 | 172 | 173 | 174 | 175 | 176 | 177 | 178 |
| 360 | 361 | 362 | 363 | 364 | 365 | 366 | 367 | 368 | 369 | 370 | 371 | 372 | 373 | 374 |
| Q | N | M | F | C | A | G | Y | D | T | K | Q | E | D | A |
| 178A | 179 | 180 | 181 | 182 | 183 | 184 | 185 | 185A | 185B | 186 | 187 | 188 | 189 | 190 |
| 375 | 376 | 377 | 378 | 379 | 380 | 381 | 382 | 383 | 384 | 385 | 386 | 387 | 388 | 389 |
| C | Q | G | D | S | G | G | P | H | V | T | R | F | K | D |
| 191 | 192 | 193 | 194 | 195 | 196 | 197 | 198 | 199 | 200 | 201 | 202 | 203 | 204 | 205 |
| 390 | 391 | 392 | 393 | 394 | 395 | 396 | 397 | 398 | 399 | 400 | 401 | 402 | 403 | 404 |
| T | Y | F | V | T | G | I | V | S | W | G | E | G | C | A |
| 206 | 207 | 208 | 209 | 210 | 211 | 212 | 213 | 214 | 215 | 216 | 217 | 218 | 220 | 221 |
| 405 | 406 | 407 | 408 | 409 | 410 | 411 | 412 | 413 | 414 | 415 | 416 | 417 | 418 | 419 |

TABLE 1-continued

Chymotryspin numbering of Factor X

| R | K | G | K | Y | G | I | Y | T | K | V | T | A | F | L |
|---|---|---|---|---|---|---|---|---|---|---|---|---|---|---|
| 222 | 223 | 223A | 224 | 225 | 226 | 227 | 228 | 229 | 230 | 231 | 232 | 233 | 234 | 235 |
| 420 | 421 | 422 | 423 | 424 | 425 | 426 | 427 | 428 | 429 | 430 | 431 | 432 | 433 | 434 |
| K | W | I | D | R | S | M | K | T | R | G | L | P | K | A |
| 236 | 237 | 238 | 239 | 240 | 241 | 242 | 243 | 244 | 245 | 246 | 247 | 248 | 249 | 250 |
| 435 | 436 | 437 | 438 | 439 | 440 | 441 | 442 | 443 | 444 | 445 | 446 | 447 | 448 | |
| K | S | H | A | P | E | V | I | T | S | S | P | L | K | |
| 251 | 252 | 253 | 254 | 255 | 256 | 257 | 258 | 259 | 260 | 261 | 262 | 263 | 264 | |

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length.

As used herein, the amino acids that occur in the various sequences of amino acids provided herein are identified according to their known, three-letter or one-letter abbreviations (Table 2). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

In keeping with standard polypeptide nomenclature described in *J. Biol. Chem.*, 243: 3557-3559 (1968), and adopted 37 C.F.R. §§1.821-1.822, abbreviations for the amino acid residues are shown in Table 2:

TABLE 2

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | proline |
| K | Lys | Lysine |
| H | His | Histidine |
| Q | Gln | Glutamine |
| E | Glu | glutamic acid |
| Z | Glx | Glu and/or Gln |
| W | Trp | Tryptophan |
| R | Arg | Arginine |
| D | Asp | aspartic acid |

TABLE 2-continued

Table of Correspondence

| SYMBOL | | |
|---|---|---|
| 1-Letter | 3-Letter | AMINO ACID |
| N | Asn | asparagine |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 2) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH$_2$ or to a carboxyl-terminal group such as COOH.

As used herein, a "hydrophobic amino acid" includes any one of the amino acids determined to be hydrophobic using the Eisenberg hydrophobicity consensus scale. Exemplary are the naturally occurring hydrophobic amino acids, such as isoleucine, phenylalanine, valine, leucine, tryptophan, methionine, alanine, glycine, cysteine and tyrosine (Eisenberg et al., (1982) Faraday Symp. Chem. Soc. 17:109-120). Non-naturally-occurring hydrophobic amino acids also are included.

As used herein, an "acidic amino acid" includes among the naturally-occurring amino acids aspartic acid and glutamic acid residues. Non-naturally-occurring acidic amino acids also are included.

As used herein, a "polar amino acid" refers to an amino acid that is a hydrophile, such that the side chains prefer to reside in an aqueous (i.e. water) environment. Such amino acids generally are located on the surface of a protein. Such amino acids generally are classified if they include those with polar side chains that have a functional group such as an acid, amide, alcohol or amine that contains oxygens or nitrogens that can participate in hydrogen bonding with water. Exemplary of such amino acids are Arg (R), Asn (N), Asp (D), Glu (E), Gln (O), H is (H), Lys (K), Ser (S), Thr (T), and Tyr (Y). Cys (C) and Trp (W) are also considered to be weakly polar.

As used herein, a polar and neutral amino acid is a polar amino acid that contains a neutral side chain. Exemplary of such amino acid residues for replacement are Asn (N), Gln (O), Ser (S), Thr (T), Cys (C) or Tyr (Y).

As used herein, "naturally occurring amino acids" refer to the 20 L-amino acids that occur in polypeptides.

As used herein, "non-natural amino acid" refers to an organic compound containing an amino group and a carboxylic acid group that is not one of the naturally-occurring amino acids listed in Table 2. Non-naturally occurring amino acids thus include, for example, amino acids or analogs of amino acids other than the naturally-occurring amino acids and include, but are not limited to, the D-isostereomers of amino acids. Exemplary non-natural amino acids are known to those of skill in the art and can be included in a modified factor VII polypeptide.

As used herein, suitable conservative substitutions of amino acids are known to those of skill in this art and can be made generally without altering the biological activity of the resulting molecule. Those of skill in this art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in TABLE 3 as follows:

TABLE 3

| Original residue | Exemplary conservative substitution |
| --- | --- |
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule can not be paired. Such unpaired ends will, in general, not exceed 20 nucleotides in length.

As used herein, "primary sequence" refers to the sequence of amino acid residues in a polypeptide.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

As used herein, the terms "homology" and "identity" are used interchange-ably, but homology for proteins can include conservative amino acid changes. In general to identify corresponding positions the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073).

As use herein, "sequence identity" refers to the number of identical amino acids (or nucleotide bases) in a comparison between a test and a reference polypeptide or polynucleotide. Homologous polypeptides refer to a pre-determined number of identical or homologous amino acid residues. Homology includes conservative amino acid substitutions as well identical residues. Sequence identity can be determined by standard alignment algorithm programs used with default gap penalties established by each supplier. Homologous nucleic acid molecules refer to a pre-determined number of identical or homologous nucleotides. Homology includes substitutions that do not change the encoded amino acid (i.e., "silent substitutions") as well identical residues. Substantially homologous nucleic acid molecules hybridize typically at moderate stringency or at high stringency all along the length of the nucleic acid or along at least about 70%, 80% or 90% of the full-length nucleic acid molecule of interest. Also contemplated are nucleic acid molecules that contain degenerate codons in place of codons in the hybridizing nucleic acid molecule. (For determination of homology of proteins, conservative amino acids can be aligned as well as identical amino acids; in this case, percentage of identity and percentage homology varies). Whether any two nucleic acid molecules have nucleotide sequences (or any two polypeptides have amino acid sequences) that are at least 80%, 85%, 90%, 95%, 96%, 97%, 98% or 99% "identical" can be determined using known computer algorithms such as the "FAST A" program, using for example, the default parameters as in Pearson et al. *Proc. Natl. Acad. Sci. USA* 85: 2444 (1988) (other programs include the GCG program package (Devereux, J., et al., *Nucleic Acids Research* 12(I): 387 (1984)), BLASTP, BLASTN, FASTA (Atschul, S. F., et al., *J. Molec. Biol.* 215:403 (1990); *Guide to Huge Computers*, Martin J. Bishop, ed., Academic Press, San Diego (1994), and Carillo et al. *SIAM J Applied Math* 48: 1073 (1988)). For example, the BLAST function of the National Center for Biotechnology Information database can be used to determine identity. Other commercially or publicly available programs include DNAStar "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. *J. Mol. Biol.* 48: 443 (1970), as revised by Smith and Waterman (*Adv. Appl. Math.* 2: 482 (1981)). Briefly, a GAP program defines similarity as the number of aligned symbols (i.e., nucleotides or amino acids) that are similar, divided by the total number of symbols in the shorter of the two sequences. Default parameters for the GAP program can include: (1) a unary comparison matrix (containing a value of 1 for identities and 0 for non identities) and the weighted comparison matrix of Gribskov et al. *Nucl. Acids Res.* 14: 6745 (1986), as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" represents a comparison between a test and a reference polypeptide or polynucleotide. In one non-limiting example, "at least 90% identical to" refers to percent identities from 90 to 100% relative to the reference polypeptides. Identity at a level of 90% or more is indicative of the fact that, assuming for exemplification purposes a test and reference polynucleotide length of 100 amino acids are compared, no more than 10% (i.e., 10 out of 100) of amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often without relying on software.

As used herein, it also is understood that the terms "substantially identical" or "similar" varies with the context as understood by those skilled in the relevant art, but that those of skill can assess such.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application.

As used herein, reference to an isolated or purified protein or catalytically active protein thereof means that it is substantially free of cellular material or other contaminating proteins from the cell of tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as proteolytic and biological activities, of the substance. Methods for purification of the proteins to produce substantially pure polypeptides are known to those of skill in the art.

The term substantially free of cellular material includes preparations of proteins in which the protein is separated from cellular components of the cells from which it is isolated or recombinantly-produced. In one embodiment, the term substantially free of cellular material includes preparations of protease proteins having less than about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than, about, or equal to 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight), 20%, 10%, 5% or less of chemical precursors or non-protease chemicals or components.

As used herein, production by recombinant methods by using recombinant DNA methods refers to the use of the well known methods of molecular biology for expressing proteins encoded by cloned DNA.

As used herein, vector (or plasmid) refers to discrete elements that are used to introduce heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as bacterial artificial chromosomes, yeast artificial chromosomes and mammalian artificial chromosomes. Selection and use of such vehicles are well known to those of skill in the art. As used herein, expression refers to the process by which nucleic acid is transcribed into mRNA and translated into peptides, polypeptides, or proteins. If the nucleic acid is derived from genomic DNA, expression can, if an appropriate eukaryotic host cell or organism is selected, include processing, such as splicing of the mRNA.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, an adenovirus refers to any of a group of DNA-containing viruses that cause conjunctivitis and upper respiratory tract infections in humans.

As used herein, naked DNA refers to histone-free DNA that can be used for vaccines and gene therapy. Naked DNA is the genetic material that is passed from cell to cell during a gene transfer processed called transformation or transfection. In transformation or transfection, purified or naked DNA that is taken up by the recipient cell will give the recipient cell a new characteristic or phenotype.

As used herein, operably or operatively linked when referring to DNA segments means that the segments are arranged so that they function in concert for their intended purposes, e.g., transcription initiates in the promoter and proceeds through the coding segment to the terminator.

As used herein, an agent that modulates the activity of a protein or expression of a gene or nucleic acid either decreases or increases or otherwise alters the activity of the protein or, in some manner, up- or down-regulates or otherwise alters expression of the nucleic acid in a cell.

As used herein, a "chimeric protein" or "fusion protein" refers to a polypeptide operatively-linked to a different polypeptide. A chimeric or fusion protein provided herein can include one or more modified FX polypeptides, or a portion thereof, and one or more other polypeptides for any one or more of a transcriptional/translational control signals, signal sequences, a tag for localization, a tag for purification, part of a domain of an immunoglobulin G, and/or a targeting agent. A chimeric FX polypeptide also includes those having their endogenous domains or regions of the polypeptide exchanged with another polypeptide. These chimeric or fusion proteins include those produced by recombinant means as fusion proteins, those produced by chemical means, such as by chemical coupling, through, for example, coupling to sulfhydryl groups, and those produced by any other method whereby at least one polypeptide (i.e. FX), or a portion thereof, is linked, directly or indirectly via linker(s) to another polypeptide.

As used herein, operatively-linked when referring to a fusion protein refers to a protease polypeptide and a non-protease polypeptide that are fused in-frame to one another. The non-protease polypeptide can be fused to the N-terminus or C-terminus of the protease polypeptide.

As used herein, a targeting agent, is any moiety, such as a protein or effective portion thereof, that provides specific binding to a cell surface molecule, such a cell surface receptor, which in some instances can internalize a bound conjugate or portion thereof. A targeting agent also can be one that promotes or facilitates, for example, affinity isolation or purification of the conjugate; attachment of the conjugate to a surface; or detection of the conjugate or complexes containing the conjugate.

As used herein, derivative or analog of a molecule refers to a portion derived from or a modified version of the molecule.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving coagulation, including those mediated by coagulation proteins and those in which coagulation proteins play a role in the etiology or pathology. Diseases and disorders also include those that are caused by the absence of a protein such as in hemophilia, and of particular interest herein are those disorders where coagulation does not occur due to a deficiency of defect in a coagulation protein.

As used herein, "procoagulant" refers to any substance that promotes blood coagulation.

As used herein, "anticoagulant" refers to any substance that inhibits blood coagulation As used herein, "hemophilia" refers to a bleeding disorder caused by a deficiency in a blood clotting factors. Hemophilia can be the result, for example, of absence, reduced expression, or reduced function of a clotting factor. The most common type of hemophilia is hemophilia A, which results from a deficiency in factor VIII. The second most common type of hemophilia is hemophilia B, which results from a deficiency in factor IX. Hemophilia C, also called FXI deficiency, is a milder and less common form of hemophila.

As used herein, "congenital hemophilia" refers to types of hemophilia that are inherited. Congenital hemophilia results from mutation, deletion, insertion, or other modification of a clotting factor gene in which the production of the clotting factor is absent, reduced, or non-functional. For example, hereditary mutations in clotting factor genes, such as factor VIII and factor IX result in the congenital hemophilias, Hemophilia A and B, respectively.

As used herein, "acquired hemophilia" refers to a type of hemophilia that develops in adulthood from the production of autoantibodies that inactivate FVIII.

As used herein, "bleeding disorder" refers to a condition in which the subject has a decreased ability to control bleeding due to poor blood clotting. Bleeding disorders can be inherited or acquired, and can result from, for example, defects or deficiencies in the coagulation pathway, defects or deficiencies in platelet activity, or vascular defects.

As used herein, "acquired bleeding disorder" refers to bleeding disorders that results from clotting deficiencies caused by conditions such as liver disease, vitamin K deficiency, or coumadin (warfarin) or other anti-coagulant therapy.

As used herein, "treating" a subject having a disease or condition means that a polypeptide, composition or other product provided herein is administered to the subject.

As used herein, a therapeutic agent, therapeutic regimen, radioprotectant, or chemotherapeutic mean conventional drugs and drug therapies, including vaccines, which are known to those skilled in the art. Radiotherapeutic agents are well known in the art.

As used herein, treatment means any manner in which the symptoms of a condition, disorder or disease are ameliorated or otherwise beneficially altered. Hence treatment encompasses prophylaxis, therapy and/or cure. Treatment also encompasses any pharmaceutical use of the compositions herein. Treatment also encompasses any pharmaceutical use of a modified FX and compositions provided herein.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced. Prophylaxis includes reduction in the risk of developing a disease or condition and/or a prevention of worsening of symptoms or progression of a disease or reduction in the risk of worsening of symptoms or progression of a disease.

As used herein an effective amount of a compound or composition for treating a particular disease is an amount that is sufficient to ameliorate, or in some manner reduce the symptoms associated with the disease. Such amount can be administered as a single dosage or can be administered according to a regimen, whereby it is effective. The amount can cure the disease but, typically, is administered in order to ameliorate the symptoms of the disease. Typically, repeated administration is required to achieve a desired amelioration of symptoms.

As used herein, "therapeutically effective amount" or "therapeutically effective dose" refers to an agent, compound, material, or composition containing a compound that is at least sufficient to produce a therapeutic effect. An effective amount is the quantity of a therapeutic agent necessary for preventing, curing, ameliorating, arresting or partially arresting a symptom of a disease or disorder.

As used herein, "patient" or "subject" to be treated includes humans and or non-human animals, including mammals. Mammals include primates, such as humans, chimpanzees, gorillas and monkeys; domesticated animals, such as dogs, horses, cats, pigs, goats, cows; and rodents such as mice, rats, hamsters and gerbils.

As used herein, a combination refers to any association between two or among more items. The association can be spatial or refer to the use of the two or more items for a common purpose.

As used herein, a composition refers to any mixture of two or more products or compounds (e.g., agents, modulators, regulators, etc.). It can be a solution, a suspension, liquid, powder, a paste, aqueous or non-aqueous formulations or any combination thereof.

As used herein, an "article of manufacture" is a product that is made and sold. As used throughout this application, the term is intended to encompass modified protease polypeptides and nucleic acids contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "kit" refers to a packaged combination, optionally including reagents and other products and/or components for practicing methods using the elements of the combination. For example, kits containing a modified protease polypeptide or nucleic acid molecule provided herein and another item for a purpose including, but not limited to, administration, diagnosis, and assessment of a biological activity or property are provided. Kits optionally include instructions for use.

As used herein, animal includes any animal, such as, but not limited to; primates including humans, gorillas and monkeys; rodents, such as mice and rats; fowl, such as chickens; ruminants, such as goats, cows, deer, sheep; ovine, such as pigs and other animals. Non-human animals exclude humans as the contemplated animal. The proteases provided herein are from any source, animal, plant, prokaryotic and fungal.

As used herein, gene therapy involves the transfer of heterologous nucleic acid, such as DNA, into certain cells, target cells, of a mammal, particularly a human, with a disorder or condition for which such therapy is sought. For purposes herein, gene therapy involves the transfer of nucleic acid encoding a modified FX polypeptide provided herein. The nucleic acid, such as DNA, is introduced into the selected target cells, such as directly or in a vector or other delivery vehicle, in a manner such that the heterologous nucleic acid, such as DNA, is expressed and a therapeutic product encoded thereby is produced. Alternatively, the heterologous nucleic acid, such as DNA, can in some manner mediate expression of DNA that encodes the therapeutic product, or it can encode a product, such as a peptide or RNA that in some manner mediates, directly or indirectly, expression of a therapeutic product. Genetic therapy also can be used to deliver nucleic acid encoding a gene product that replaces a defective gene or supplements a gene product produced by the mammal or the cell in which it is introduced. The introduced nucleic acid can encode a therapeutic compound, such as a protease or modified protease, that is not normally produced in the mammalian host or that is not produced in therapeutically effective amounts or at a therapeutically useful time. The heterologous nucleic acid, such as DNA, encoding the therapeutic product can be modified prior to introduction into the cells of the afflicted host in order to enhance or otherwise alter the product or expression thereof. Genetic therapy also can involve delivery of an inhibitor or repressor or other modulator of gene expression.

As used herein, a therapeutically effective product for gene therapy is a product that is encoded by heterologous nucleic acid, typically DNA, that, upon introduction of the nucleic acid into a host, a product is expressed that ameliorates or eliminates the symptoms, manifestations of an inherited or acquired disease or that cures the disease. Also included are biologically active nucleic acid molecules, such as RNAi and antisense.

As used herein, recitation that a polypeptide "consists essentially" of a recited sequence of amino acids means that only the recited portion, or a fragment thereof, of the full-length polypeptide is present. The polypeptide can optionally, and generally will, include additional amino acids from another source or can be inserted into another polypeptide As used herein, the singular forms "a," "an" and "the" include plural referents unless the context clearly dictates otherwise. Thus, for example, reference to compound, comprising "an extracellular domain"" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-111B Commission on Biochemical Nomenclature (see, (1972) *Biochem.* 11:1726).

B. Hemostasis and Factor X

Provided herein are modified Factor X (FX) polypeptides, including modified activated Factor X (FXa) polypeptides and catalytically active fragments thereof. As the first enzyme in the common pathway of thrombus formation, FX occupies a unique and important position in the coagulation cascade. Deficiencies in coagulation factors IX or VIII, upstream of FX, lead to inadequate production of FXa. The consequence of inadequate FXa is reduced levels of thrombin and clot-forming fibrin, which results in hemophilia (Roberts et al. (2006). Hemophilia A and hemophilia B. In MA Lichtman et al., eds., Williams Hematology, 7th ed., pp. 1867-1886. New York: McGraw-Hill). Thus, FX is an attractive therapeutic to bypass deficiencies in upstream coagulation factors, and could also be useful in other, hemophilia-independent, medicinal applications, such as to promote blood clotting during or following surgical procedures.

While FXa has the potential to serve as a therapeutic procoagulant that bypasses the deficiencies in other clotting factors in the cascade, use of fully functional FX as a therapeutic has proven to be impractical due to excessive activation of systemic coagulation. While association of active FXa with its activated cofactor, FVa, to form the prothrombinase complex results in a greater than 100,000-fold increase in thrombin activation, FXa alone is capable of low levels of thrombin activation (Nesheim et al. (1979) *J. Biol. Chem.*, 254:10952-10962). Thus, infusion of FXa can result in undesirable elicitation of coagulation. In fact, administration of FXa causes thrombin generation in vivo and is used to induce disseminated intravascular coagulation (DIC) in animal models (Kruithof et al. (1997) *Thombosis and Haemostasis* 77(2): 308-311; Giles et al. (1984) *J. Clin. Invest.* 74(6):2219-2225). Therefore, the use of FXa as a therapeutic is limited because of concerns that such pharmaceutical preparations are thrombogenic and could lead to disseminated intravasal coagulation. Accordingly, research for use of FX as a therapeutic has focused on the use of the inactive zymogen FX (see e.g. U.S. Pat. No. 4,501,731). The modified FX polypeptides, including modified FXa polypeptides, provided herein overcome these problems.

Another limitation of FXa use as a therapeutic resides in the short half-life of circulating FXa due to rapid inactivation thereof by plasma protease inhibitors, such as antithrombin (AT) III and Protein C (Gitel et al. (1984) *J. Biol. Chem.* 259(11):6890-6895; Giles et al. (1988) *Br. J. Haematol.* 69(4):491-497).

Undesirable activities of FXa are not limited to those of the coagulation pathway. FXa also plays a well-documented role in activating immune and inflammation pathways and mitogenesis to response to injury (Altieri (1993) *Blood* 81:569-579; Altieri (1995) *FASEB J.* 9:860-865; Cirino et al. (1997) *J. Clin. Invest.* 99(10):2446-2451; Leadley et al. (2001) *Curr. Opin. Pharmacol.* 1(2):169-175). FXa-mediated activation of the immune, inflammation, and mitogenesis pathways, can result in undesired effects such as edema (Cirino et al. (1997) *J. Clin. Invest.* 99(10):2446-2451). These activities of FXa occur independent of Factor V, and are discussed in more detail below.

Importantly, the zymogen conformation of Factor X (discussed below) is not capable of activating the above-mentioned pathways (Ambrosini et al. (1997) *J. Biol. Chem.* 272(13):8340-8345). Therefore, to overcome the pitfalls of using FXa as a therapeutic described above, the FXa polypeptides provided herein are modified to alter the structural capabilities of the polypeptide such that the polypeptides mimic the zymogen conformation and exhibit low to no activity in the absence of FVa. In the presence of saturating levels of FVa, however, the activity of the FXa mutants is fully restored once assembled into the prothrombinase complex. As demonstrated herein, FXa forms of modified FX provided herein include those that exhibit a relative cofactor dependence as a ratio of the catalytic activity in the presence of FVa compared to in its absence of greater than or equal to 150,000 or more, and generally greater than or equal to 300,000 or more, which is approximately 50-fold to 100-fold or greater than exhibited by wild-type FXa.

Existing FXa mutants in the art that are stated to exhibit zymogen-like activity, such as the mutant I195L (corresponding to I16L by chymotrypsin numbering, see Ivanciu et al. (2011) Nature Biotechnology, 29:1028-1033 and Bunce et al. (2011) *Blood,* 117:290-8), still retain substantial activity in the absence of FVa. This can limit therapeutic applications of certain zymogen-like FXa mutants. It is found herein that modified FXa zymogen-like polypeptides that exhibit greatly increased cofactor dependence exhibit therapeutic advantages by facilitating coagulation without conferring toxicity associated with thrombosis or inflammation. Hence, provided herein are such modified FXa polypeptides. In addition, FXa polypeptides provided herein also include those that resist inactivation by plasma protease inhibitors, such as ATM, and otherwise exhibit increased or improved circulating half-life.

The following sections and subsections describe the coagulation pathway, the structure, processing and regulation of FX forms (e.g. zymogen and FXa forms), and the function of FX in the coagulation pathway. The structure, function, and regulation of FV-dependent and independent activities also are described below.

1. Coagulation Pathway

Coagulation is a complex process by which blood forms clots. It is an important part of hemostasis, the cessation of blood loss from a damaged vessel, wherein a damaged blood vessel wall is covered by a platelet and fibrin-containing clot to stop bleeding and begin repair of the damaged vessel. Disorders of coagulation can lead to an increased risk of bleeding (hemorrhage) or obstructive clotting (thrombosis). The coagulation pathway is highly conserved, and involves cellular (platelet) and protein (coagulation factor) components. In the primary phase of coagulation, platelets are activated to form a haemostatic plug at the site of injury. Secondary hemostasis follows, involving plasma coagulation factors, which act in a proteolytic cascade resulting in the formation of fibrin strands which strengthen the platelet plug.

The proteolytic cascade, leading to reinforcement of the platelet plug, occurs by a series of reactions, in which a circulating zymogen (inactive enzyme precursor) of a serine protease and its glycoprotein co-factor are activated to become active components that then catalyze the next reaction in the cascade, ultimately resulting in cross-linked fibrin. Coagulation factors are generally indicated by Roman numerals (e.g., factor X). A lowercase "a" appended to the Roman numeral indicates an active form (e.g., factor Xa).

The coagulation cascade is classically divided into three pathways: the extrinsic (or Tissue Factor) pathway, the intrinsic (or contact activation) pathway and the common pathway (see FIGS. 2A-2B). The intrinsic and extrinsic pathways occur in parallel, and converge at factor X to form the common pathway, which results in the formation of a Fibrin clot (Mann et al. (1990) *Blood,* 76(1):1-16).

a. Tissue Factor (Extrinsic) Coagulation Pathway

Coagulation is initiated almost instantly after an injury to the blood vessel has damaged the endothelium lining the vessel. The primary pathway for the initiation of blood coagulation is the Tissue Factor pathway. Tissue Factor (TF) is a transmembrane protein, expressed on the surface of cells normally not exposed to flowing blood. Upon exposure to blood, TF associates with the circulating serine protease Factor VII (FVII), which leads to the activation of Factor VII (FVIIa) on the membrane surface. The TF/FVIIa complex (also called tenase) then catalyzes the conversion of inactive, circulating Factor X (FX) to the active serine protease (FXa) on the surface of the TF-bearing cell.

b. Intrinsic Coagulation Pathway

The intrinsic coagulation pathway involves enzymes that are intrinsically present in plasma and begins with formation of a protein complex, including Factor XII (FXII), on exposed collagen after the integrity of a blood vessel is compromised. Among other events, FXII is activated to FXIIa to initiate the protease cascade. FXIIa converts (Factor XI) FXI into FXIa. Factor XIa activates Factor IX (FIX) to FIXa. FIXa then forms a tenase complex with its glycoprotein co-factor, FVIIIa, which activates FX to FXa on the surface of activated platelets.

c. Common Pathway

The extrinsic and intrinsic pathways converge upon cleavage of the zymogen form of FX by the TF/FVIIa and FVIIIa/FIXa tenase complexes, and hence FX activation, to form active FX (FXa) (FIGS. 2A-2B). Interaction of FXa with its activated co-factor, Factor V (FVa), in a 1:1 stoichiometry, in the presence of $Ca^{2+}$ leads to the formation of the membrane-associated prothrombinase complex. The prothrombinase complex is formed at the membrane surface by association of FXa with its FVa co-factor, substrate prothrombin and a phospholipid surface. Prothrombinase acts by cleaving prothrombin (also called FII) at Arg 323-Ile324, followed by cleavage at Arg 274-Thr275 to yield the active serine protease, thrombin (also called FIIa) (Krishnaswamy et al. (1986) *J Biol. Chem.,* 261:8977-8984; Krishnaswamy et al. (1987) *J.Biol. Chem.,* 262:3291-3299). Thrombin then converts Fibrinogen to Fibrin, which leads to a clot at the site of injury following cross-linking of Fibrin proteins by activated transglutaminase Factor XIII.

In addition to converting Fibrinogen to Fibrin, FXa-activated Thrombin is involved in amplifying and propagating coagulation by feeding back to further activate the intrinsic coagulation pathway by directly cleaving, and thereby activating, several components of the intrinsic coagulation pathway (e.g., converting Factor XI to Factor XIa and converting Factor VIII to Factor VIIIa). Thrombin also propagates coagulation and thrombus by activating Factor V of the common pathway and by activating platelets.

In addition to its role in the prothrombinase complex, FXa is capable of feedback activity by activating coagulation factors, in addition to Thrombin, including FV, FVIII, and FVII and may play a role in activating protease activated receptors (PARs) (Foster et al. (1983) *J. Biol. Chem.,* 258(22):13970-13977; Eaton et al. (1986) *Biochemistry,* 25(2):505-512; Butenas and Mann (1996) *Biochemistry,* 35(6):1904-1910).

2. Factor V-Independent Activity

In the absence of Factor V/Va, FXa is capable of low levels of thrombin activation and also functions in non-haemostatic cellular events, including mediating inflammation responses, gene expression, and cell proliferation (Camerer et al. (1999) *J. Biol. Chem.* 274:32225-32233; Cirino et al. (1997) *J. Clin. Invest.* 99(10):2446-2451; Gajdusek et al. (1986) *J. Cell Biol.* 103:419-428; Gasic et al. (1992) *Proc. Natl. Acad. Sci. USA.* 89:2317-2320; Herbert et al. (1998) *J. Clin. Invest.* 101:993-1000; Ko et al. (1996) *J. Clin. Invest.* 98:1493-1501; Papapetropoulos et al. (1998) *Proc. Natl. Acad. Sci. USA* 95:4738-4742; Senden et al. (1998). *J. Immunol.* 161:4318-4324). These FV/FVa-independent activities are described in further detail below.

a. Thrombin Activation

In the absence of its Factor Va cofactor, FXa maintains some catalytic activity, leading to prothrombin activation, albeit significantly reduced (Nesheim et al. (1979) *J. Biol. Chem.,* 254:10952-10962). The pathways of prothrombin activation are distinct depending on whether FXa is in solution or incorporated into the prothrombinase complex with FVa on the surface of phospholipids. In solution, prothrombin activation proceeds by an initial cleavage of prothrombin at Arg274, generating Prethrombin and fragment 1.2, followed by a second cleavage within the Prethrombin fragment at Arg 323 to yield the disulfide-linked A and B chains of α-thrombin (Mann et al. (1981) *Methods Enzymol.,* 80:286-302).

In contrast, when membrane-bound prothrombin is activated by membrane-bound prothrombinase, prothrombin activation proceeds by cleavage at Arg323 first, yielding disulfide linked chains of Meizothrombin as an intermediate product, followed by cleavage of Meizothrombin at Arg 274 to generate α-thrombin and the activation peptide fragment 1.2 (Krishnaswamy et al. (1986) *J. Biol. Chem.* 261(19) 8977-8984).

The meizothrombin intermediate is itself a competent serine protease which serves as a potent vasoconstrictor (Thompson et al. (1987) *Blood,* 70:410a. (Abstract 1494); Thompson et al. (1990) *J. Vasc. Med. Biol.,* 1:348; Doyle and Mann (1990) *J. Biol. Chem.,* 265(18):10693-10701) and can act as a regulatory element in blood coagulation by activating anticoagulant Protein C (discussed below) when bound to thrombomodulin (Mann et al. (1990) *Blood,* 76(1):1-16).

b. Inflammation and Cell Proliferation

In addition to its role in the coagulation pathway, FXa contributes to other physiological mechanisms including inflammation and mitogenesis (Leadley et al. (2001) *Curr. Opin. Pharmacol.* 1(2):169-175). FXa initiates these signaling pathways in various cells primarily by binding to Effector Cell Protease Receptor (EPR-1) or by proteolytic activation of Protease Activated Receptors (PARs).

i. Effector Cell Protease Receptor-1 (EPR-1)

Effector Cell Protease Receptor-1 (EPR-1) has been identified as a receptor for FXa on the surface to monocytes, leukocytes, vascular endothelial cells, and smooth mucscle cells (Altieri (1995) *FASEB J*9:860-865; Nicholson et al. (1996) *J. Biol. Chem.* 271:28407-28413; Bono et al. (1997) *J. Cell. Physiol.* 172:36-43). Binding of FXa to EPR-1 results in leukocyte activation (Altieri (1995) *J. Leukocyte Biol.* 58:120-127), thrombin formation (Bouchard et al. (1997) *J. Biol. Chem.* 272:9244-9251; Ambrosini and Altieri (1996) *J. Biol. Chem.* 271:1243-1248), and cell proliferation (Nicholson et al. (1996) *J. Biol. Chem.* 271:28407-28413). Leukocyte activation is accompanied by synthesis of cytokines and expression of adhesion molecules that lead to vasodilatation and inflammation as a part of the immune response.

The FXa sequence LFTRKL (SEQ ID NO: 555), located at positions 83-88 of the mature FX sequence, is the recognition site for EPR-1 (Ambrosini et al. (1997) *J. Biol. Chem.* 272 (13): 8340-8345; Cirino et al. (1997) *J. Clin. Invest.* 99(10): 2446-2451). FXa enzymatic activity is not required for EPR-1 binding (Herbert et al. (1998) *J. Clin. Invest.* 101:993-1000; Ambrosini et al. (1997) *J. Biol. Chem.* 272 (13): 8340-8345). However, activation of FX is required for EPR-1 binding, because zymogen conformation of Factor X prevents access to the EPR-1 binding motif. Conformational transition in the light chain of FXa unmasks the interaction domain, permitting EPR-1 binding followed by signal transduction.

ii. Protease Activated Receptors (PARs)

FXa is also capable of initiating cell signaling via proteolytic activation of protease activated receptors (PARs). PARs are G-protein-coupled receptors, highly expressed in platelets, endothelial cells, myocytes and neurons (Macfarlane et al. (2001) *Pharmacol. Rev.* 53(2):245-282). In particular, FXa cleaves Protease Activated Receptor-1 (PAR-1) and Protease Activated Receptor-2 (PAR-2) to release an N-terminal peptide which in turn acts as a tethered ligand, leading to activation (McLean et al. (2001) *Thombosis Research* 103: 281-297). Activation of PAR-1 and PAR-2 results in increased cell proliferation, mediated by G-protein-coupled signaling (Macfarlane et al. (2001) *Pharmacol. Rev.* 53(2): 245-282), increased production of proinflammatory cytokines and adhesion molecules (McLean et al. (2001) *Thombosis Research* 103:281-297; Senden et al. (1998) *J. Immunol.* 161:4318-4324; Papapetropoulos et al. (1998) *Proc. Natl. Acad. Sci. USA* 95:4738-4742), and increased production of prothrombotic Tissue Factor (TF) (McLean et al. (2001) *Thombosis Research* 103:281-297). FXa enzymatic activity is required to activate PAR signaling (McLean et al. (2001) *Thombosis Research* 103:281-297).

3. Factor X Inhibitors

Factor X activity is inhibited by three major anticoagulant protein systems in the blood: antithrombin III (AT-III)/heparin, Protein C/Protein S, and tissue factor pathway inhibitor (TFPI). The three systems play distinct and complementary roles in inhibiting Factor X activity, thereby inhibiting the coagulation pathway.

Antithrombin (AT-III) inhibits the serine protease activity of Factor Xa by trapping the enzyme at an intermediate stage of the proteolytic process as Factor X initiates an attack on the reactive bond on the reactive site loop on AT-III. Heparin aids the inhibition of Factor Xa by inducing a conformational change in the reactive site loop of AT-III to facilitate entry into the active site of Factor Xa and by interacting directly with basic residues on the surface of factor Xa to facilitate the formation of a stable, inactive ternary complex (Rezaie, A R, (2000) *J. Biol. Chem.*, 275(5):3320-3327; Langdown et al. (2004) *J. Biol. Chem.*, 279 (45): 47288-47297).

In the protein C pathway, Protein C, another vitamin K-dependent serine protease zymogen that circulates in plasma, is converted by limited proteolysis to activated protein C (APC) by the thrombin-thrombomodulin-endothelial protein C receptor complex on endothelial surfaces following thrombin formation as a result of the coagulation pathway (Esmon and Owen (1981) *Proc. Natl. Acad. Sci. USA,* 78:2249-2252). Active Protein C (APC) then inhibits Factor Xa activity by inactivating Factor Va (FVa) by proteolytic cleavage. APC digestion of FVa is a facilitated by Protein S by catalyzing the Protein C cleavage of FVa and by binding FXa to inhibit inactivation of Protein C (Mosnier and Griffin J H (2006) *Front. Biosci.,* 11: 2381-2399).

Tissue Factor Pathway Inhibitor (TFPI) inhibits Factor Xa by directly binding Factor Xa, but not the Factor X zymogen, at or near the active site (Broze et al. (1988) *Blood,* 71 (2): 335-343; Broze et al. (1990) *Biochemistry,* 7539-7546). Like AT-III, discussed above, TFPI inhibition of FXa is accelerated in the presence of heparin. The FXa-TFPI complex then inhibits the Tissue Factor coagulation pathway (and additional FX activation) by binding and inhibiting the FVIIa-Tissue Factor tenase complex.

C. Factor X Structure and Activation

Factor X, like other coagulation enzyme, circulates in blood as an inactive precursor, called a zymogen, that requires proteolytic cleavage for activation. Zymogens possesses about 10,000-fold or less proteolytic activity when compared to the serine protease produced following activation. Initiation of coagulation at the site of vascular damage, as discussed above, leads to a series of reactions in which a zymogen is converted to an active protease through specific proteolytic cleavage to generate an active enzyme for the successive reaction. FXa is generated upon proteolytic cleavage of the FX zymogen by TF/FVIIa and FVIIIa/FIXa tenase complexes (see FIGS. 2A-2B). This culminates in blood cell activation and the conversion of soluble fibrinogen to insoluble fibrin and hence the formation of the clot. Excess proteases are removed by reaction with circulating protease inhibitors that act as "suicide" substrates or those that recognize the active enzymes. Thus, proteolytic activation of the coagulation zymogens is a key regulatory feature of the coagulation cascade.

Factor X cDNA has been cloned from numerous mammalian species. Exemplary FX polypeptides include, but are not limited to, human (precursor prepropeptide set forth in SEQ ID NO: 2 and encoded by SEQ ID NO: 1; and mature form set forth in SEQ ID NO:134), Northern White-Cheeked Gibbon (precursor prepropeptide set forth in SEQ ID NOS: 393 and mature form set forth in SEQ ID NO:404), Olive Baboon (precursor prepropeptide set forth in SEQ ID NO:394 and mature form SEQ ID NO: 405), Rhesus Monkey (precursor prepropeptide set forth in SEQ ID NO: 395 and mature form set forth in SEQ ID NO:406), Dusky titi monkey (precursor prepropeptide set forth in SEQ ID NO: 396 and mature form set forth in SEQ ID NO:407), African elephant (precursor prepropeptide set forth in SEQ ID NO:397 and mature form set forth in SEQ ID NO:408), mouse (precursor prepropeptide set forth in SEQ ID NO: 398 and mature form set forth in SEQ ID NO:409), rabbit (precursor prepropeptide set forth in SEQ ID NO: 399 and mature form set forth in SEQ ID NO:410), rat (precursor prepropeptide set forth in SEQ ID NO: 400 and mature form set forth in SEQ ID NO:411), dog (precursor prepropeptide set forth in SEQ ID NO:401 and mature form set forth in SEQ ID NO:412), pig (precursor prepropeptide set forth in SEQ ID NO:402 and mature form set forth in SEQ ID NO:413), and bovine (precursor prepropeptide set forth in SEQ ID NO:403 and mature form set forth in SEQ ID NO:414). Several allelic variants of human FX have also been identified (Cargill et al. (1999) *Nat. Gen.,* 22:231-238; SEQ ID NOS: 547-552).

The processes and structural features that regulate processing of the inactive FX zymogen precursor upon secretion into the blood stream, resulting in generation of the functional FXa active enzyme, are outlined below with exemplification to human FX mature, zymogen and FXa polypeptides. Based on such description, one of skill in the art knows or can determine corresponding mature, zymogen, FXa and catalytically active forms thereof in other FX polypeptides, including allelic or species variants thereof. For example, it is understood that the zymogen form includes the two-chain form of any of the above single-chain mature form, whereby amino acid residues are excised due to intrachain proteolysis of the single chain FX such that the polypeptide contains a light chain and heavy chain linked by a disulfide bond. In addition, the FXa of species and allelic variants and other variants generally exists as a two-chain form thereof that further lacks the activation peptide. In view of the description herein exemplified with respect to human FX and the knowledge in the art of species and allelic variants thereof, one of skill in the art is familiar with and can identify residues corresponding to such forms in the exemplified allelic and species variants and other variants known in the art.

1. FX Processing, Post-Translational Modification and Zymogen Secretion

Factor X is a serine endoproteinase and a member of the S1 peptidase family of proteases that bear a chymotrypsin-like fold. The human gene encoding Factor X is located on the long arm of chromosome 13 (13q34). It is composed of 8 exons and is approximately 33 kilobases in length, and is expressed predominantly in the liver. The human FX transcript is 1560 nucleotides in length, which includes a short 5' untranslated region, and open reading frame (including stop codon) of 1467 nucleotides, and a 3' untranslated region. The 1467 nucleotide open reading frame (or FX mRNA; SEQ ID NO: 1) encodes a 488 amino acid pre-propeptide (Swiss-Prot accession no. P00742; SEQ ID NO: 2).

Factor X is synthesized in the liver as a single-chain precursor protein termed a prepropeptide. The prepropeptide FX is processed as it travels through the secretory pathway of hepatic cells. With exemplification to human FX, the pre-propeptide contains a 31 amino acid N-terminal signal peptide (amino acids 1-31 of SEQ ID NO: 2) that directs the Factor X polypeptide into the hepatocyte secretory pathway by way of translocation into the endoplasmic reticulum (ER). The signal peptide is then cleaved by signal peptidase, leaving a 9 amino acid propeptide (aa 32-40 of SEQ ID NO: 2) at the new amino terminus to generate a propeptide form of FX. As the polypeptide is folded into its tertiary structure in the lumen of the ER, 12 disulfide bonds are formed. With reference to human FX, these bonds are formed between the cysteine residues at positions 17 and 22, 50 and 61, 55 and 70, 72 and 81, 89 and 100, 96 and 109, 111 and 124, 132 and 302, 201 and 206, 221 and 237, 350 and 364, 375 and 403 corresponding to residues set forth in SEQ ID NO:134 (See FIG. 1).

The resultant polypeptide is then post-translationally modified in the lumen of the ER. The N-terminal propeptide serves as the recognition element which leads to the conversion of several glutamic acid residues (corresponding to amino acids 6, 7, 14, 16, 19, 20, 25, 26, 29, 32, and 39 of the FX polypeptide set forth in SEQ ID NO: 134)) to γ-carboxyglutamic acid (Gla) by the vitamin K-dependent carboxylase (Furie and Furie (1988) *Cell*, 53:505-518). This γ-carboxylation step plays a role in trafficking of the FX precursor between the ER and the Golgi apparatus (Stanton and Wallin (1992) *Biochem. J.*, 284:25-31), and is involved in optimal $Ca^{2+}$-mediated activation of the circulating mature FX zymogen. The FX polypeptide is further post-translationally modified in the trans-Golgi compartment by β-hydroxylation and glycosylation. Studies have shown that glycosylation of these residues is important for recognition of the Factor X zymogen by its physiological activators (Yang et al. (2009) *J. Thromb. Haemost.*, 7(10):1696-1702). For example, with reference to human FX, hydroxylation occurs at an aspartic acid residue corresponding to position 63 of the FX polypeptide set forth in SEQ ID NO:134) (McMullen et al. (1983) *Biochemistry*, 22:2875-2884) and glycosylation occurs at threonine residues at positions corresponding to residues 159 and 171 and at asparagine residues at positions corresponding to residues 181 and 191 of the FX polypeptide set forth in SEQ ID NO: 134) (Inoue and Morita (1993) *Eur. J. Biochem*, 218:153-163).

The propeptide is removed by proteolytic cleavage in the trans-Golgi apparatus to generate a mature form lacking the propeptide (set forth in SEQ ID NO:134), which occurs prior to secretion of the zymogen into the bloodstream. In addition, intrachain proteolysis of the single chain mature FX also occurs in the trans-Golgi compartment, which can precede or follow the cleavage of the propeptide (Stanton and Wallin (1992) *Biochem. J.* 284:25-31). This results in removal of amino acids 140-142 corresponding to residues set forth in SEQ ID NO:134, and the generation of a two-chain polypeptide. Thus, the resulting secreted FX zymogen exists as a light chain and a heavy chain linked by a disulfide bond. For example, with reference to the mature single-chain form set forth in SEQ ID NO:134, the light chain is 130 amino acids (corresponding to residues 1-139 of SEQ ID NO: 134) and the heavy chain is 306 amino acids (corresponding to residues 143-448 of SEQ ID NO: 134). The secreted zymogen exists as a two-chain form due to the excising of amino acids 140-142 of SEQ ID NO: 134, whereby the light and heavy chains of FX remain linked by a disulfide bond between Cys 132 (of the light chain) and Cys 302 (of the heavy chain) with reference to amino acid residues set forth in SEQ ID NO: 134 (Di Scipio et al. (1977) *Biochemistry*, 16:698-706).

Figure 1:
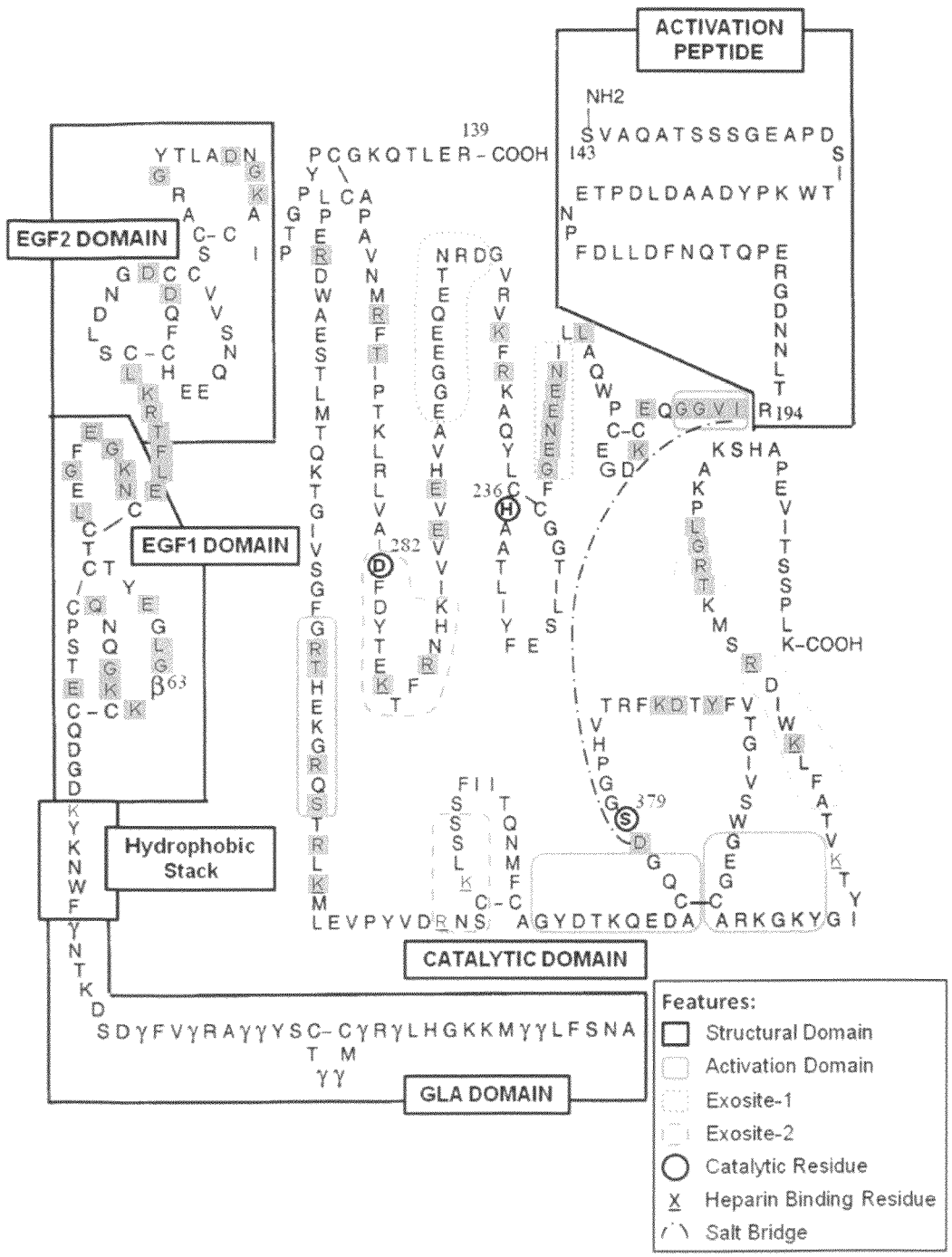
FIG. 1 is a structural depiction of Factor X zymogen form containing a light chain and a heavy chain linked by a disulfide bond (adapted from Venkateswarlu et al., *Biophysical Journal* 82:1190-1206 (2002)). Amino acid residues targeted for mutagenesis are highlighted.

The secreted two-chain zymogen inactive form, containing a light chain and a heavy chain, contains an activation peptide at the N-terminus of the heavy chain that must be removed for activation of the enzyme (see FIG. 1). With respect to human FX set forth in SEQ ID NO:134, the wild-type FXa zymogen has a light chain having a sequence of amino acids corresponding to amino acids 1-139 of SEQ ID NO:134 and a heavy chain having a sequence of amino acids corresponding to amino acids 143-448, whereby the activation peptide is made up of 52 amino acid residues at the amino terminus of the heavy chain. The active FX (FXa) is generated by proteolytic cleavage to remove the activation peptide, which is discussed further below. The light and heavy chains of FXa remain linked by a disulfide bond between Cys 132 (of the light chain) and Cys 302 (of the heavy chain) with reference to amino acid residues set forth in SEQ ID NO: 134.

Prior to cleavage of the activation peptide (discussed below), the circulating zymogen form of Factor X exists in a structural conformation that is structurally distinct from FXa with respect to four major segments. These segments, collectively called the "activation domain", are the N-terminus of the heavy chain (the activation peptide plus residues 195-198 of SEQ ID NO: 134), and residues 325-334, 365-377, and 400-406 (corresponding to residues set forth in SEQ ID NO:134). The activation peptide at the N-terminus of the heavy chain conformationally blocks the activation domain segments of FX. In the inactive zymogen, the activation domain covers a portion of the substrate binding pocket (the S1 site), thereby restricting substrate access and permitting little catalytic activity.

2. Activation and Generation of Activated Factor X (FXa)

Activation cleavage of the zymogen form, and generally release of an activation peptide, is required to generate an active serine protease. Generally, for serine proteases, the conversion of the zymogen to active serine protease requires cleavage following Arg[15] (typically the bond between Arg[15] and Ile[16]), by chymotrypsin numbering. This can result in the removal of an activation peptide and expose a new N-terminus in the catalytic domain beginning with Ile[16]. For example, with respect to FX, activated FX (FXa) is generated from the FX zymogen by removal of the activation peptide, which occurs following proteolytic cleavage between amino acids 194-195 corresponding to residues set forth in SEQ ID NO: 134. For FX, proteolytic cleavage is initiated in vivo by upstream activated serine proteases of the coagulation pathway, namely the TF/FVIIa and FVIIIa/FIXa tenase complexes. Activation by proteolytic cleavage also can be induced in vitro, for example, using Russell's Viper Venom FX Activator as described herein in the Examples.

Proteolytic processing, to remove the activation peptide, unmasks a new N-terminus of the heavy chain, corresponding to hydrophobic residues Ile195-Gly198 in mature FX set forth in SEQ ID NO: 134. The resulting FXa contains a catalytically active heavy chain, linked to the light chain by a disulfide bond. With respect to the sequence of amino acids set forth in SEQ ID NO:134, wild-type FXa has a light chain having a sequence of amino acid residues corresponding to amino acids 1-139 of SEQ ID NO: 134 and a heavy chain having a sequence of amino acids corresponding to amino acid residues 195-448 of SEQ ID NO: 134. The light and heavy chains of FXa remain linked by a disulfide bond between Cys 132 (of the light chain) and Cys 302 (of the heavy chain) with reference to amino acid residues set forth in SEQ ID NO:134.

The exposed new N-terminal sequence of the heavy chain folds back into the catalytic domain and inserts into the N-terminal binding cleft in a sequence-specific manner. The N-terminal insertion leads to the formation of a salt bridge between the α-NH2 group of Ile16 and Aps194 in the interior of the catalytic domain, by chymotrypsin numbering (corresponding to Ile195 and Asp378 by numbering of mature FX set forth in SEQ ID NO:134). Salt bridge formation is associated with numerous changes in catalytic domain structure including rearrangements of the activation domains, formation of the oxyanion hole required for catalysis and the formation of a substrate binding site. These changes lead to the maturation of the active serine protease. For example, rearrangement of the tertiary structure to accommodate the formation of a buried salt bridge between the newly exposed N-terminus with Asp378 in the hydrophobic core leads to a conformational change in the activation domain that orders the S1 subsite and results in an active protease.

The heavy chain residues 195-448 of SEQ ID NO:134 feature the chymotrypsin-like serine protease domain. Like other members of the chymotrypsin-like serine protease family, the protease domain of FX contains two Greek key β-barrel subdomains that converge at the catalytic active site. Residues His236, Asp282, and Ser379 make up the active-site catalytic triad of the active protease. Additional auto-proteolysis of FXa following Arg429 of SEQ ID NO: 134 converts the α-form of FXa to the α-form (Mertens and Bertina, *Biochem. J.* (1980) 185:647-658). However, these two forms of FXa are functionally indistinguishable (Pryzdial and Kessler, *J. Biol. Chem.* (1996) 271:16621-16626).

The active site of the protease domain is divided into four (4) sub pockets, numbered S1-S4. The S1 pocket is located next to the catalytic triad in the three-dimensional structure, and is the major determinant of substrate specificity and binding. The S1 pocket is formed by the loops formed by residues 398-403 and 373-379 of SEQ ID NO:134, which are linked by a Cys403-Cys375 disulfide bond, and residues 409-412 of SEQ ID NO: 134. Within the S1 pocket, Asp373, Gly400, and Gly410 are key residues for substrate binding selectivity. The S2 site is a small, shallow pocket, formed by the loop corresponding to residues 270-279 of SEQ ID NO:134 (Rai et al., *Curr. Med. Chem.* (2001) 8(2):101-119). A Tyr corresponding to Tyr279 of SEQ ID NO: 134 is important for enzyme specificity at the S2 subsite (Rezaie, *J Biol. Chem.* (1996) 271(39): 23807-23814). The S3 area of FXa is located on the rim of the S1 pocket, is solvent exposed, and confers little binding specificity. The S4 subsite is formed between the loop containing amino acids 270-279 and 350-359 of SEQ ID NO: 134 and contains 3 ligand binding domains: the "hydrophobic box" (formed by residues Tyr279, Phe356 and Trp399 of SEQ ID NO: 134), the "cationic hole" (formed by the side chain of Glu277 and the backbone of K276 of SEQ ID NO: 134), and the water site (formed by residues Thr278, Ile357, and Thr359 of SEQ ID NO: 134) (Rai et al., *Curr. Med. Chem.* (2001) 8(2):101-119).

The light chain of FXa and zymogen forms has three characteristic structural domains, each of which possesses distinct functional properties (Leytus et al., *Biochemistry*. (1986) 25:5098-5102; Padmanabhan et al., *J. Mol. Biol.* (1993) 232: 947-966). The γ-carboxyglutamic acid (GLA)-rich domain (residues 1-39 of SEQ ID NO: 134) contains the 11 GLA residues mentioned above, and is important for $Ca^{2+}$-dependent FX association with cellular membranes: a requirement for assembly of the prothrombinase complex (Morita and Jackson, *J. Biol. Chem.* (1986) 261(9):4015-4023). The GLA domain is followed by a short hydrophobic stack (corresponding to residues 40-45 of SEQ ID NO: 134) and two epidermal growth factor (EGF)-like domains: EGF1 (corresponding to amino acids 46-84 of SEQ ID NO:134) and EGF2 (corresponding to amino acids 85-128 of SEQ ID NO:134), which are involved in protein-protein interactions and, in the case of EGF1, $Ca^{2+}$ binding, involving residues Gly47, Gly64, Gln49, Asp/Hya63, and Asp46 (Selander-Sunnerhagen et al., *J. Biol. Chem.* (1992) 267(27):19642-19649).

Although FXa possesses a fully functional active site and contains the catalytic machinery for cleavage of prothrombin to thrombin, it is a poor catalyst for this reaction although some activity is present. This co-factor independent activity accounts for some of the deleterious side effects associated with infusion of FXa as discussed above. Generally, full activity by efficient cleavage of biological substrates requires Factor Va (FVa) as a co-factor. FVa, present on platelet membranes, binds to FXa, resulting in an increased affinity of FXa for phospholipids and an increase in catalytic activity (see e.g. Segers et al. (2007) *Thromb. Haemost.*, 98:530-542). For example, as shown in the Examples, wild-type FXa generally exhibits greater than 3000-fold increased catalytic activity for its substrate in the presence of FVa than in its absence. The core cofactor binding epitope in FXa are Arg347, Lys351 and Lys414 corresponding to residues set forth in SEQ ID NO:134 (see e.g. Rudolph et al. (2001) *J. Biol. Chem.*, 276: 5123-5128).

D. Modified Factor X Polypeptides

Provided herein are variant or modified Factor X (FX) polypeptides, including FX zymogen protease and active FX (FXa) protease polypeptides, that exhibit altered or improved activities or properties compared to the corresponding form of the FX polypeptide not containing the modification(s). In particular, such altered or improved activities or properties are evident when the FX polypeptide is activated or when it exists as a modified FXa polypeptide. Activities or properties that are altered in the modified FX polypeptides provided herein include increased FVa co-factor dependence, increased resistance to inhibitors, an increased level or extent of glycosylation, increased half-life and/or increased catalytic activity. For example, the increased resistance to inhibitors can be manifested as an increased resistance to one or both tissue factor pathway inhibitor (TFPI) or antithrombin III (AT-III). Active forms of modified FX polypeptides provided herein exhibit catalytic activity, including in the presence of FVa, and hence procoagulant activity. Such modified FX polypeptides can be used in treatment of diseases or conditions to provide coagulant activity while at the same time bypassing the requirements for enzymes that act earlier in the coagulation cascade, such as FVIIIa and FIXa.

In particular, provided herein are modified FX polypeptides, including Factor X zymogen and FXa polypeptides, when present in their active FXa form, maintain or exhibit improved local activity at the site of the wound, but exhibit little to no systemic activity in the absence of co-factor. This result is due to modification(s) provided herein that result in substantially increased co-factor dependence compared to wild-type FXa or any existing FXa variant in the art. Hence, the modified proteases provided herein as active FXa polypeptides exhibit far more potency than wildtype FXa, but can exhibit increased safety because the circulating free form can only exhibit strong (i.e., comparable to wild type FXa) activity when it is bound to FVa cofactor at the site of a wound. The modified FX polypeptides, including FX zymogen forms and FXa, provided herein can be used in therapeutic applications to treat subjects having hemophilia (hemophilia A or B), as well as in other applications to control hemostasis such as in surgery or other trauma.

Also included among modified FX polypeptides, including Factor X zymogen and FXa forms, that exhibit increased half-life. A problem with the use of Factor X/Factor Xa zymogen/proteases as therapeutics for the treatment of hemophilia is their short half-life. For example, Factor X exhibits a half-life of 24 to 40 hours. For long-term treatment of patients with hemophilia that exhibit defects or deficiencies in the coagulation pathway, a longer half-life is advantageous to avoid repeating dosing at a frequency that is inconvenient and undesired. Modified Factor X/Factor Xa zymogen/proteases provided herein exhibit altered half-life by virtue of an altered level and/or type of glycosylation. Glycosylation can increase serum-half-life of polypeptides by increasing the stability, solubility, and reducing the immunogenicity of a protein. Modified FX polypeptides provided herein, including Factor X zymogen and FXa forms, also exhibit increased half-life when in active form due to increased resistance to inhibitors, such as ATM and other inhibitors.

Modification(s) in a FX polypeptide can be made to any form of a FX polypeptide, so long as the form, when expressed, purified and processed (in vitro or in vivo) can result in a FXa containing a light chain and a heavy chain lacking the activation peptide. For purposes herein, reference to amino acid replacement(s) in a FX polypeptide herein is with respect to residues in the mature form set forth in SEQ ID NO:134, which contains the light chain (corresponding to amino acid residues 1-139) and the heavy chain (corresponding to amino acid residues 140-448), whereby the heavy chain contains amino acid residues 140-142 and a 52 amino acid activation peptide that are not normally present in a FXa form. Hence, provided herein are modified mature forms of FX. Amino acid replacements can be made at corresponding residues of any FX form or any variant FX known in the art by alignment with the mature polypeptide set forth in SEQ ID NO:134 (see e.g. FIG. 1). Thus, also provided herein are modified FX polypeptides that are two-chain zymogen forms lacking amino acid residues corresponding to amino acid residues 140-142 of SEQ ID NO:134, containing a heavy chain and a light chain linked by a disulfide bond, and that contain the amino acid replacement(s) with reference to numbering set forth in SEQ ID NO:134. Further provided herein are modified FXa forms that are two-chain forms of SEQ ID NO:134 lacking amino acid residues corresponding to amino acid residues 140-142, lacking the activation peptide in the heavy chain, containing a heavy chain and a light chain linked by a disulfide bond, and that contain the amino acid replacement(s) with reference to numbering set forth in SEQ ID NO:134. Corresponding residues in other forms of FX or in other FX polypeptides other than SEQ ID NO:134 can be identified by alignment with SEQ ID NO:134.

Reference also is made throughout the application to chymotrypsin numbering, which is a common numbering scheme used to number amino acid residues in any serine protease (Greer (1990) Proteins:Structure, Function and Genetics, 7:317-334). A corresponding numbering scheme for FX numbering based on the mature sequence set forth in SEQ ID NO:134 and chymotrypsin is provided herein in Table 1. Thus, it is also within the level of one of skill in the art to generate amino acid replacement(s) provided herein in any variant FX known in the art with reference to chymotrypsin numbering.

Hence, provided herein are modified FX polypeptides containing modifications in a mature FX set forth in SEQ ID NO:134 or in a zymogen, active or catalytically active form thereof that includes the modification(s), or a variant thereof that exhibits at least 65%, 70%, 75%, 80%, 85%, 90%, 91%, 92%, 93%, 94%, 95%, 96%, 97%, 98%, 99% or more sequence identity to SEQ ID NO:134, or to a zymogen, active or catalytically active forms thereof that include the modification(s). For example, modifications can be made with reference to any allelic or species variant known in the art, such as any set forth in any of SEQ ID NOS: 393-414 or 547-552, or other variant known in the art (see e.g. Section D.5), or zymogens, active or catalytically active forms thereof.

The resulting modified FX polypeptide can be a single chain form or can contain two or more chains. Typically, the modified FX polypeptide is a two-chain zymogen or is a two-chain active FXa. It is understood that any modified polypeptide provided herein as a single-chain polypeptide can be autoactivated or activated to generate a two-chain form. Further, any modified polypeptide provided herein in zymogen form containing an activation peptide, can be activated by known activators (e.g. other coagulation factor complexes or RVV) to generate a modified FXa two-chain form. The activation steps can be performed in vitro or can be effected upon in vivo administration, for example, in vivo administration of the zymogen form. For example, when activation is performed in vitro, the activation peptide or other cleaved peptide sequences can be purified from the final FXa form, such as is known in the art and described elsewhere herein including in the Examples. The activities of a modified FX polypeptide are typically exhibited in its two-chain active FXa form.

For example, modified FX polypeptides provided herein include two-chain forms having a light chain and a heavy chain linked by at least one disulfide bond. In particular, modifications in a FX polypeptide are in a zymogen two-chain form having a light chain having a sequence of amino acids corresponding to amino acids 1-139 of SEQ ID NO:134 and a heavy chain having a sequence of amino acids corresponding to amino acids 143-448, or in a variant thereof that is a zymogen and that exhibits at least 65%, 70%, 75%, 80%, 85%, 90%, 91%, 92%, 93%, 94%, 95%, 96%, 97%, 98%, 99% or more sequence identity to a FX having a light chain having a sequence of amino acids corresponding to amino acids 1-139 of SEQ ID NO:134 and a heavy chain having a sequence of amino acids corresponding to amino acids 143-448. In other examples, modification(s) in a FX polypeptide are in a two-chain FXa form that lacks the activation peptide. For example, modification(s) in a FX polypeptide are in a FXa having a light chain having a sequence of amino acids corresponding to amino acid residues 1-139 of SEQ ID NO:134 and a heavy chain having a sequence of amino acids corresponding to amino acids 195-448 of SEQ ID NO:134 or in a variant thereof that has catalytic activity and that exhibits at least 65%, 70%, 75%, 80%, 85%, 90%, 91%, 92%, 93%, 94%, 95%, 96%, 97%, 98%, 99% or more sequence identity to a FXa having a light chain having a sequence of amino acids corresponding to amino acid residues 1-139 of SEQ ID NO:134 and a heavy chain having a sequence of amino acids corresponding to amino acids 195-448 of SEQ ID NO:134, or to a catalytically active portion thereof.

Modifications provided herein of a starting, unmodified reference polypeptide include amino acid replacements or substitution, additions or deletions of amino acids, or any combination thereof. For example, modified FX polypeptides include those with 1, 2, 3, 4, 5, 6, 7, 8, 9, 10, 11, 12, 13, 14, 15, 16, 17, 18, 19, 20, 30, 40, 50 or more modified positions. Also provided herein are modified FX polypeptides with two or more modifications compared to a starting reference FX polypeptide. Modified FX polypeptides include those with 2, 3, 4, 5, 6, 7, 8, 9, 10, 11, 12, 13, 14, 15, 16, 17, 18, 19, 20, 30, 40, 50 or more modified positions.

The modification(s) provided herein can include any one or more modification(s) that alter an activity or property of a FXa form of a FX polypeptide, for example, to increase cofactor dependence, increase resistance to inhibitors, alter glycosylation, and/or increase half-life compared to the FXa form not containing the modification(s). For example, modified FX polypeptides provided herein can include modification(s) that increase cofactor dependence. In such examples, cofactor dependence can be increased by decreasing catalytic activity in the absence of FVa (FVa-independent catalytic activity) and/or decreasing substrate affinity (e.g. for prothrombin) in the absence of cofactor FVa. In another example, modified FX polypeptides provided herein can include modification(s) that increase half-life. In such examples, increased half-life can be effected by virtue of one or more modification(s) that increase resistance to an inhibitor, such as TFPI or AT-III. In other examples, increased half-life can effected by virtue of one or more modification(s) that results in the addition of new glycosylation sites such that the modified FX polypeptide is glycosylated or hyperglycosylated. In particular examples herein, modified FX polypeptides provided herein can include modification(s) that increase cofactor dependence and increase half-life compared to the FX not containing the modification(s). In some examples, a single modification, such as single amino acid substitution or replacement, alters 2, 3, 4 or more properties or activities of a FX polypeptide. Modified FX polypeptides, and generally FXa forms thereof, provided herein can be assayed for each property and activity to identify the range of effects of a modification. Such assays are known in the art and described below.

The resulting modified FX polypeptides provided herein, when in active two-chain form as a modified FXa, exhibit FVa-dependent coagulation activity. When in active form, the FVa-dependent activity is preserved, i.e. retained or increased, compared to the FXa not containing the modification(s). For example, activity is at least 10%, 20%, 30%, 40%, 50%, 60%, 70%, 80%, 90%, 100%, 110%, 120%, 130%, 140%, 150%, 160%, 170%, 180%, 190% or more of the FVa-dependent activity of the FXa not containing the modification(s).

Any modification provided herein can be combined with any other modification known to one of skill in the art (e.g. any set forth in Section D.5) so long as the resulting modified FX polypeptide exhibits increased co-factor dependence, increased resistance to inhibitors, altered glycosylation (e.g. hyperglycosylation) and/or increased half-life and preserves FVa-dependent coagulation activity compared to the FX polypeptide not containing the modification(s) when each is in its active two-chain form.

Other modifications that are or are not in the primary sequence of the polypeptide also can be included in a modified FX polypeptide, including, but not limited to, the addition of a carbohydrate moiety, the addition of a polyethylene glycol (PEG) moiety, the addition of an Fc domain, etc. For example, such additional modifications can be made to increase the stability or half-life of the protein. Modified FX polypeptides provided herein also include FX polypeptides that are additionally modified by the cellular machinery and include, for example, glycosylated, γ-carboxylated and β-hydroxylated polypeptides.

Also provided herein are nucleic acid molecules that encode any of the modified FX polypeptides provided herein. In particular examples, the nucleic acid sequence can be codon optimized, for example, to increase expression levels of the encoded sequence. The particular codon usage is dependent on the host organism in which the modified polypeptide is expressed. One of skill in the art is familiar with optimal codons for expression in mammalian or human cells, bacteria or yeast, including for example *E. coli* or *Saccharomyces cerevisiae*. For example, codon usage information is available from the Codon Usage Database available at kazusa.or.jp.codon (see e.g. Richmond (2000) *Genome Biology*, 1:241 for a description of the database). See also, Forsburg (2004) *Yeast*, 10:1045-1047; Brown et al. (1991) *Nucleic Acids Research*, 19:4298; Sharp et al. (1988) *Nucleic Acids Res.*, 12:8207-8211; Sharp et al. (1991) *Yeast*, 657-78).

In some examples, the encoding nucleic acid molecules also can be modified to contain a heterologous sequence to alter processing of the polypeptide. For example, the nucleic acid can contain nucleic acid encoding a heterologous signal sequence, prepropeptide (containing signal sequence and propeptide) or propeptide in order to increase secretion or production of the polypeptide or otherwise improve the functional production of the protein. In particular examples, the nucleic acid can contain nucleic acid encoding a prepropeptide or propeptide of a vitamin-K dependent protein that exhibits an altered (e.g. reduced) affinity for gamma-carboxylase than the propeptide of Factor X. Gamma-carboxylase is the enzyme that catalyzes the modification of glutamate (Glu) to gamma carboxyl glutamic acid (Gla), which is required for the activity of Factor X. The affinity of the propeptide of Factor X has the highest affinity for gamma-carboxylase than other vitamin-K dependent polypeptides, such as factor VII, protein S, factor IX, protein C and prothrombin (Camire et al. (2000) *Biochemistry*, 39:14322-9). Modifying the encoding nucleic acid to contain a prepropeptide or propeptide form another vitamin-K dependent polypeptide exhibiting reduced affinity for gamma-carboxylase enhances gamma-carboxylation by allowing greater substrate turnover, which in turn improves protein production resulting in an increased percentage of total protein produced that is gamma-carboxylated. For example, provided herein are nucleic acids encoding a modified FX polypeptide that contains a heterologous sequence encoding the prothrombin propeptide (set forth as amino acid residues 1-43 of any of SEQ ID NO:415-546). As described elsewhere herein, the encoding nucleic acids also can be produced in vitamin K epoxide reductase (VKOR)-transfected cells in order to further increase the fraction of carboxylated factor X (see e.g. Sun et al. (2005) *Blood*, 106: 3811-3815).

The modified polypeptides and encoding nucleic acid molecules provided herein can be produced by standard recombinant DNA techniques known to one of skill in the art. Any method known in the art to effect mutation of any one or more amino acids in a target protein can be employed. Methods include standard site-directed or random mutagenesis of encoding nucleic acid molecules, or solid phase polypeptide synthesis methods. In particular, total chemical synthesis methods, including peptide synthesis followed by peptide ligation can be employed. Nucleic acid molecules encoding a FX polypeptide can be subjected to mutagenesis, such as random mutagenesis of the encoding nucleic acid, error-prone PCR, site-directed mutagenesis (using e.g., a kit, such as kit such as QuikChange available from Stratagene), overlap PCR, gene shuffling, or other recombinant methods. The nucleic acid encoding the polypeptides can then be introduced into a host cell to be expressed heterologously. In some examples, the modified FX polypeptides are produced synthetically, such as using total chemical synthesis, solid phase or solutions phase peptide synthesis.

In the subsections below, exemplary modified FX polypeptide provided herein exhibiting altered properties and activities, including modified FX zymogen or FXa forms and encoding nucleic acid molecules, are described. The description below is organized based on one or more properties or activities from among increased co-factor dependence, increased resistance to inhibitors (e.g. AT-III) and altered glycosylation. It is understood that these properties and activities are not mutually exclusive, such that one or more of the modified polypeptides provided herein can exhibit one, two or all of the above-identified properties or activities.

Further, in some examples herein below of modified FX polypeptides that contain a modification at position 195 to Val, Ala, Ser or Thr and/or at position 196 to Ile, Ala, Ser or Thr with reference to positions set forth in SEQ ID NO:134 (corresponding to residues 16 and 17 by chymotrypsin numbering), the modified FX polypeptide does not contain a heterologous activation peptide from another serine protease to result in a protease processing site not present in wildtype factor X. In one example, as a precursor, mature or zymogen form, a modified factor X polypeptide provided herein that contains an amino acid replacement at position 195 and/or 196 (e.g. with Ile, Val, Ala, Ser or Thr) contains Arg194 (Arg15 by chymotrypsin numbering) as part of the protease cleavage site. In particular examples, a precursor, mature or zymogen form of a factor X polypeptide provided herein contains a FX activation peptide corresponding to amino acid residues 143-194 of the sequence of amino acids set forth in SEQ ID NO:134. In examples herein, modified FXa polypeptides provided herein in active form containing a modification at position 195 and/or 196 (e.g. with Ile, Val, Ala, Ser or Thr) are rendered active by activation cleavage and processing of a modified FX zymogen that contains an activation peptide corresponding to amino acid residues 143-194 of the sequence of amino acids set forth in SEQ ID NO:134.

1. Altered Glycosylation

Provided herein are modified FX polypeptides, including modified FX zymogen and modified FXa polypeptides, that contain one or more modification(s) in a FX polypeptide such that glycosylation of the polypeptide is altered. The modifications can be insertions, deletion or replacement of amino acids. In particular, the modifications are amino acid replacements. Glycosylation sites provide a site for attachment of monosaccharides and oligosaccharides to a polypeptide via a glycosidic linkage, such that when the polypeptide is produced in a eukaryotic cell capable of glycosylation, it is glycosylated. The two main types of glycosylation are N-linked glycosylation, where the sugar units are attached via the amide nitrogen of an asparagine residue, and O-linked glycosylation, where the sugar units are attached via the hydroxyl group of serine, threonine, hydroxylysine or hydroxyproline residues. Other more minor forms of glycosidic linkages include S-linkage to cysteine and C-linkage to tryptophan. N-linked glycosylation occurs at asparagines in the consensus sequence -Asn-Xaa-Ser/Thr/Cys where Xaa is not proline. There is no known motif for O-glycosylation, although O-glycosylation is more probable in sequences with a high proportion of serine, threonine and proline residues. The presence of a potential glycosylation site does not, however, ensure that the site will be glycosylated during post-translational processing in the ER. Furthermore, the level of glycosylation may vary at a given site, and one site may have many different glycan structures.

FX is generally a glycosylated protein with two O-linked and two N-linked glycosylation sites present in the activation peptide portion of the polypeptide (corresponding to residues Thr159, Thr171, Asn181 and Asn191 with reference to SEQ ID NO:134). These glycosylation residues are required for zymogen activation by physiological activators (see e.g. Yang et al. (2009) *J. Thromb. Haemost.*, 7:1696-1702).

It is found herein that further glycosylation sites can be introduced into FX, which can alter the function and activity of the polypeptide. Generally, the function and activity of the polypeptide is improved or increased by the addition of further glycosylation sites, thereby providing a therapeutic benefit. For example, glycosylation can increase serum-half-life of polypeptides by increasing the stability, solubility, and reducing the immunogenicity of a protein. Glycosylation can increase the stability of proteins by reducing the proteolysis of the protein and can protect the protein from thermal degradation, exposure to denaturing agents, damage by oxygen free radicals, and changes in pH. Glycosylation also can allow the target protein to evade clearance mechanisms that can involve binding to other proteins, including cell surface receptors. Carbohydrate moieties that contain sialic acid can affect the solubility of a protein. The sialic acid moieties are highly hydrophilic and can shield hydrophobic residues of the target protein. This decreases aggregation and precipitation of the target protein. Decreased aggregation also aids in the prevention of the immune response against the target protein. Carbohydrates can furthermore shield immunogenic sequences from the immune system. The volume of space occupied by the carbohydrate moieties can decrease the available surface area that is surveyed by the immune system. These properties lead to the reduction in immunogenicity of the target protein.

Hence, FX polypeptides provided herein that exhibit altered glycosylation can exhibit improved pharmacokinetic and pharmacodynamic properties, including increased half-life in the blood. The modified FX polypeptides provided herein that exhibit altered glycosylation also can exhibit other altered activities and properties such as increased catalytic activity and/or increased resistance to inhibitors. In particular, included among modified FX polypeptides provided herein are those that exhibit altered glycosylation, and that one or both of increased co-factor dependence (see e.g. Section D.2) or increased resistance to inhibitors, such as TFPI or AT-III (see e.g. Section D.3).

Included among the FX polypeptides provided herein are those that have been modified by altering the level and/or type of glycosylation compared to an unmodified FX polypeptide. Glycosylation can be increased or decreased compared to the unmodified FX polypeptide. In some instances, the level or extent of glycosylation is increased, resulting in a hyperglycosylated FX polypeptide. This can be achieved, for example, by incorporation of at least one non-native glycosylation site not found in the unmodified FX polypeptide to which a carbohydrate is linked. Hyperglycosylated FX polypeptides also can be generated by linkage of a carbohydrate moiety to at least one native glycosylation site found but not glycosylated in the unmodified FX polypeptide.

The modified FX polypeptides provided herein can contain altered, such as new, O-linked glycosylation, N-linked glycosylation or O-linked and N-linked glycosylation. In some examples, a modified FX polypeptide includes 1, 2, 3, 4, 5 or more carbohydrate moieties, each linked to different glycosylation sites. The glycosylation site(s) can be a native glycosylation site(s) and/or a non-native glycosylation site(s). In some examples, the modified FX polypeptide is glycosylated at more than one non-native glycosylation site. For example, a modified FX polypeptide can be modified to introduce 1, 2, 3, 4, 5 or more non-native glycosylation sites.

Non-native glycosylation sites can be introduced by amino acid replacement. O-glycosylation sites can be created, for example, by amino acid replacement of a native residue with a serine or threonine. N-linked glycosylation sites can be created by creating the motif Asn-Xaa-Ser/Thr/Cys, where Xaa is not proline. Creation of this consensus sequence by amino acid modification could involve replacement of a native amino acid residue with an asparagine, replacement of a native amino acid residue with a serine, threonine or cysteine, or replacement of a native amino acid residue with an asparagine and amino acid replacement of native residue with a serine, threonine or cysteine. Non-native glycosylation sites can be created in any region in the FX polypeptide. For example, one or more glycosylation sites can be introduced into the light chain and/or the heavy chain. In some examples, one or more glycosylation sites are introduced in an EGF1 domain of the light chain. In other examples, non-native glycosylation sites are introduced into the protease domain region of the heavy chain. The level of glycosylation (e.g. the number of introduced non-native glycosylation sites) can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the level of glycosylation of unmodified or wild-type FX polypeptide.

Exemplary modification(s) provided herein include introducing a non-native glycosylation by modification with one or more amino acid replacement(s) that include, but are not limited to, amino acid replacement(s) in an unmodified FX polypeptide with: N at a position corresponding to position 51; N at a position corresponding to position 56 and S at a position corresponding to position 58; N at a position corresponding to position 62 and S at a position corresponding to position 64; N at a position corresponding to position 65 and S at a position corresponding to position 67; N at a position corresponding to position 67; N at a position corresponding to position 73 and S at a position corresponding to position 75; N at a position corresponding to position 75 and S at a position corresponding to position 77; N at a position corresponding to position 77 and S at a position corresponding to position 79; N at a position corresponding to position 78 and S at a position corresponding to position 80; S at a position corresponding to position 82; N at a position corresponding to position 83; N at a position corresponding to position 82 and S at a position corresponding to position 84; N at a position corresponding to position 85 and S at a position corresponding to position 87; N at a position corresponding to position 86 and S at a position corresponding to position 88; N at a position corresponding to position 95 and S at a position corresponding to position 97; N at a position corresponding to position 114; N at a position corresponding to position 119 and S at a position corresponding to position 121; S at a position corresponding to position 122; N at a position corresponding to position 215 and S at a position corresponding to position 217; N at a position corresponding to position 243 and S at a position corresponding to position 245; N at a position corresponding to position 264 and S at a position corresponding to position 266; N at a position corresponding to position 293 and S at a position corresponding to position 295; N at a position corresponding to position 388; N at a position corresponding to position 389 and S at a position corresponding to position 391; N at a position corresponding to position 428 and S at a position corresponding to position 430 and/or N at a position corresponding to position 429 and S at a position corresponding to position 431, each with reference to amino acid positions set forth in SEQ ID NO:134. With reference to the amino acid residues set forth in SEQ ID NO:134, non-limiting amino acid replacement(s) in a modified FX polypeptide provided herein to introduce a non-native glycosylation are set forth in Tables 4.

TABLE 4

| | | | |
|---|---|---|---|
| E51N | Q56N/Q58S | K62N/G64S | L65N/E67S |
| E67N | L73N/G75S | G75N/E77S | E77N/K79S |
| G78N/N80S | E82S | L83N | E82N/F84S |
| T85N/K87S | R86N/L88S | D95N/D97S | G114N |
| D119N/G121S | K122S | R243N/K245S | E264N/E266S |
| T293N/R295S | K388N | D389N/Y391S | T428N/G430S |
| R429N/L431S | E215N/N217S | | |

Typically, the modified FX polypeptides provided herein that have altered glycosylation retain at least one activity of FX. In some instances, altered glycosylation levels or changes in the type of glycosylation present on a modified FX polypeptide compared to an unmodified FX polypeptide can be manifested as increased catalytic activity and/or increased resistance to inhibitors, such as AT-III. The increased activity can be by virtue of the added glycosylation, or can be by virtue of secondary amino acid modification(s) that act independently or in concert with the altered glycosylation to effect changes in activity. Section D.2 and Section D.3 describe exemplary modification(s) that can be combined with any of the modification(s) provided herein to alter glycosylation.

For example, modified FX polypeptides provided herein that have altered glycosylation exhibit, when in active form, increased half-life, increased catalytic activity and/or increased coagulant activity compared to an unmodified FX. The half-life of the modified FX polypeptides with altered glycosylation can be increased by at least or about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the half-life of unmodified or wild-type FX polypeptide. Half-life can be determined using as measured in assays known in the art, such as by performing pharmacokinetics (PK) or clearance studies as described herein (e.g. Example 7). The catalytic activity of the modified FX polypeptides with altered glycosylation can be increased by at least or about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the catalytic activity of unmodified or wild-type FX polypeptide as measured in assays either in vivo or in vitro. The increase in catalytic activity can be FVa-dependent and/or FVa-independent catalytic activity. Typically, modified FX polypeptides provided herein that have altered glycosylation retain FVa-dependent catalytic activity or exhibit increased FVa-dependent catalytic activity such that the modified polypeptides exhibit increased co-factor dependence. Exemplary of such modified FX polypeptides are set forth in Section D.2.

In other examples, modified FX polypeptides provided herein that have altered glycosylation exhibit, when in active form, increased resistance to inhibitors, such as increased resistance to AT-III compared to an unmodified FX. The resistance to inhibitors, such as AT-III, of the modified FX polypeptides with altered glycosylation can be at least 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold, 1500-fold, 2000-fold, 2500-fold, 3000-fold, 3500-fold, 4000-fold, 4500-fold, 5000-fold, 5500-fold, 6000-fold or more increased. Thus, when evaluated in an appropriate in vitro, in vivo, or ex vivo assay, the modified FX polypeptides having altered glycosylation can display increased resistance to AT-III compared with that of the unmodified FX polypeptides. Exemplary of such modified FX polypeptides are set forth in Section D.3.

2. Increased Co-Factor Dependence

Provided herein are modified FX polypeptides, including modified FX zymogen and modified FXa polypeptides, that contain one or more modification(s) in a FX polypeptide and that, when in active FXa form, exhibit greater catalytic activity in the presence of co-factor FVa (FVa-dependent activity) compared to in the absence of FVa (FVa-independent activity). The modifications can be insertions, deletions or replacement of amino acids. In particular, the modifications are amino acid replacements. The modified FX polypeptides provided herein, when in active form, exhibit increased co-factor dependence as a ratio of catalytic activity in the presence of FVa to that in the absence of FVa compared to the FXa not containing the modification(s).

Although FVa acts to substantially increase the activity of FXa, wild-type FXa exhibits some activity even in the absence of FVa. For example, as exemplified in the Examples herein, the co-factor dependence of wild-type FXa (e.g. plasma-derived or recombinantly produced) is approximately 3,000. As discussed above, the FVa-independent activity can result in unwanted activities that limit the use of FXa as a therapeutic. It is found herein that limiting or reducing the FVa-independent activity can be accomplished while retaining FVa-dependent activities. Changes in catalytic activity in the presence of FVa can manifest as increased FVa-dependent coagulant activity. Thus, the unwanted activities can be reduced, minimized or ablated, while maintaining prothrombinase activity at the membrane surfaces to effect clot formation required for therapeutic applications. The modified proteases provided herein, as active FXa polypeptides, exhibit far more potency than wildtype FXa, but can be much safer because the circulating free form can only exhibit activity when it is bound to FVa cofactor at the site of a wound.

The increased co-factor dependence is achieved by modification of one or more amino acid residues in the heavy chain of FX that is (are) associated with the conformational switch from FX zymogen to FXa. Normally, FX exists in an equilibrium of conformational forms from zymogen to active protease, which favors the zymogen form prior to activation and favors the FXa form after activation. In the zymogen form, the primary specificity pocket (e.g. S1 binding site) and oxyanion hole are not present or stabilized in their "active conformations", which renders the zymogen form inactive. In addition, extended sites of substrate specificity (exosites) and FVa binding sites also are not properly formed or stabilized into "active conformations." The transition to the altered active state can be shifted upon cleavage of the bond between Arg194-Ile195 (Arg15-Ile16 by chymotrypsin numbering), which results in the creation of a new N-terminus that is involved in the formation of a salt bridge with Asp378 (Asp 194 by chymotrypsin numbering). The transition to a protease state can also occur without bond cleavage by the presence of stabilizing interactions with the FXa form. For example, the FVa cofactor provides a strong stabilizing interaction with FXa and shifts the equilibrium to the FXa form.

Upon bond cleavage, this zymogen to active enzyme transition is also associated with other conformational changes of the protease to produce an active enzyme. For example, conformational changes in the activation domain, corresponding to residues 195-198, 325-334, 366-377 and 400-406 by mature numbering with reference to SEQ ID NO:134 (corresponding to residues 16-19, 142-152, 184-193 and 216-223 by chymotrypsin numbering), reorders and stabilizes the primary specificity pocket or substrate binding site and oxyanion hole (Toso et al. (2008) *J. Biol. Chem.*, 283:18627-18635). Further, exosite 1 formed by loops containing residues 213-219 and 249-259 (corresponding to residues 34-40 and 70-80 by chymotrypsin numbering), which is involved in prothrombin binding and catalysis, exists in a proexosite state and is only expressed in an active configuration with the conformation changes that accompany the transition (Bock et al. (2007) *J. Thromb. Haemost.*, 5:81-94). The zymogen to active enzyme conformational change also leads to expression of the FVa binding site that includes Arg347, Lys351 and Lys414 in exosite 2 that form the core cofactor binding epitope (see also Bianchini (2004) *J. Biol. Chem.*, 279:3671-3679). The active enzyme conformation is also stabilized upon substrate binding.

The conformational equilibrium of FX proteins can be shifted by modification of amino acid residues that are associated with the zymogen to active enzyme transition. The modification in these residues can shift the equilibrium to a zymogen-like state. Residues associated with the zymogen to active enzyme transition include residues at the new N-terminus, such as amino acid residues 195-198 (corresponding to residues 16-19 by chymotrypsin numbering). Other residues associated with the zymogen transition include residues in the activation domain and exosites (set forth above) that either directly play a role in the conformational change or are otherwise energetically linked. Mutation of residues in these regions can result in structural perturbations of the activation domain and/or exosites of the activated enzyme in the transition process, thereby altering substrate binding and/or catalysis resulting in zymogen-like activity. For example, part of the activation domain is the autolysis loop (corresponding to residues 142-152 by chymotrypsin numbering), which if structurally altered can result in reduced proteolysis of substrate. Hence, mutations in these regions can further destabilize the FXa form, resulting in a shift in equilibrium in favor of a zymogen-like state. It is found herein that modification of residues associated with or in close proximity to the above domains also can be modified and affect FV-independent activity resulting in proteases that exhibit substantially increased co-factor dependence. Catalytic triad residues are not targeted for mutagenesis (e.g. His236, Asp282 and Ser379 with reference to SEQ ID NO:134), since they are required for catalytic activity.

In particular, modifications are made in residues in the N-terminal peptide segment that initiates the transition to FXa following bond cleavage in order to disrupt formation of or destabilize the intermolecular salt bridge or other "coupled" conformational changes that occur during the zymogen to active enzyme transition described above. For example, Ile195 and also to some extent Val196 in FXa are buried within the protein moiety, whereby an α-ammonium group of Ile 195 and the side-chain carboxylate group of Asp378 form an internal salt bridge. This salt-bridge stabilizes the active enzyme. Disruption of the salt bridge, for example by modification of amino acid residues at positions 195, 196 and/or 378, is found to result in a transformation of the active enzyme structure toward a zymogen-like structure. Modification of adjacent residues 197 and 198 also are targets for modification to transform the enzyme to a zymogen-like structure.

In addition, modifications provided herein include those in the zymogen triad residues that are known to stabilize the zymogen state in some serine proteases. For example, in the zymogen structure of chymotrypsinogen and trypsinogen, the side-chain corresponding to Asp378 (Asp194 by chymotrypsin numbering) is stabilized by an ion pair with a buried histidine at position 211 (His40 by chymotrypsin numbering), which also forms a hydrogen bond with position 219 (Ser32 by chymotrypsin numbering) (Madison et al. (1993) Science, 262:419-421). This zymogen triad (Asp 194-His40-Ser32, by chymotrypsin numbering) stabilizes the zymogen form. The corresponding zymogen triad is not present in FX, since a leucine (L) is present at position 211 (corresponding to position 32 by chymotrypsin numbering) and a glycine (G) is present at position 219 (corresponding to position 40 by chymotrypsin numbering). Hence, modifications herein include those in which a corresponding zymogen triad (Asp194-His40-Ser32, by chymotrypsin numbering) is formed in FX.

Like the zymogen form of FX, a FXa polypeptide in a zymogen-like conformational state exhibits little catalytic activity. As discussed above, the activity can be regulated by FVa co-factor. Zymogen forms of FX, and zymogen-like forms of FXa, generally exhibit reduced affinity for FVa, presumably because conformational activation of the protease domain is required to expose the FVa binding site. Nevertheless, because FVa is such a strong stabilizer, the equilibrium from the zymogen-like conformational state to FXa can be rescued in the presence of the strong stabilizing presence of excess FVa cofactor. Hence, in examples herein, zymogen-like variants exhibit little activity in the absence of FVa, but can exhibit substantial activity in the presence of FVa. The resulting FX polypeptides, when in active form, exhibit a ratio of catalytic activity in the presence of FVa compared to in the absence of FVa (also called the relative cofactor dependence) that is increased compared to the FXa not containing the modification(s). The increased cofactor dependence can be due to decreased catalytic activity in the absence of FVa and/or increased catalytic activity in the presence of FVa.

For example, modified FX polypeptides provided herein, when in active FXa form, exhibit a relative cofactor dependence of greater than 5000, such as greater than 10,000; 20,000; 30,000; 40,000; 50,000; 100,000; 200,000; 300,000; 400,000; 500,000; 600,000; 700,000; 800,000; 900,000; 1,000,000; 2,000,000; 3,000,000; 4,000,000; 5,000,000; 6,000,000; 7,000,000; 8,000,000; 9,000,000; 10,000,000, 15,000,000; 20,000,000; 25,000,000; 30,000,000; 35,000,000; 40,000,000; 45,000,000; 50,000,000 or more. Compared to FXa not containing the modification(s) the relative cofactor dependence is increased at least 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold, 1500-fold, 2000-fold, 2500-fold, 3000-fold, 4000-fold, 4500-fold, 5000-fold, 6000-fold, 7000-fold, 8000-fold, 9000-fold, 10000-fold, 15000-fold, 20000-fold or more. Thus, when evaluated in an appropriate in vitro, in vivo, or ex vivo assay, the modified FX polypeptides can display increased cofactor dependence compared with that of the unmodified FX polypeptides.

Included among such modified FX polypeptides are those that contain a modification(s) at amino acid position(s) 195, 196, 197, 198, 200, 202, 211, 214, 215, 216, 217, 218, 219, 273, 276, 306, 326, 327, 332, 334, 336, 338, 378, 420 and/or 424 in the heavy chain of a FX corresponding to positions set forth in SEQ ID NO:134. For example, modified FX polypeptides provide herein include those that contain a modification(s) at an amino acid position(s) 198, 202, 211, 214, 217, 219, 327 and/or 338. Generally, the modification is an amino acid replacement. The amino acid replacement can be to any of the other 19 amino acids at that position so long as the resulting modified FX polypeptide, when in active form, exhibits increased cofactor dependence compared to the FXa not containing the amino acid replacement(s) and retains FVa-dependent catalytic activity.

In one example, modified FX polypeptides contain at least one amino acid modification(s), such as at least one amino acid replacement(s) at a position corresponding to position 195, 196, 197, or 198, for example at least at position 196, as set forth in SEQ ID NO:134 (position 16-19 by chymotrypsin numbering). These amino acid residues correspond to the hydrophobic residues at the new N-terminus that is exposed upon activation cleavage of the FX zymogen. As discussed elsewhere herein, hydrophobic residues at the N-terminus form a salt bridge with residue Asp378 (Asp194 by chymotrypsin numbering) that is necessary for the transition from the inactive to the active state. For example, the Val residue that is present in at position 196 with reference to numbering of the exemplary FX polypeptide set forth in SEQ ID NO:134 is hydrophobic and is suited for this interaction. It is found herein that modification of an N-terminal amino acid residues 195, 196, 197 and/or 198 (corresponding to residues 16-19 by chymotrypsin numbering) to a hydrophilic neutral amino acid residue that contain a polar R group particularly acts to disrupt or destabilize salt bridge formation. Exemplary of such amino acid residues for replacement are Asn (N), Gln (Q), Ser (S), Thr (T), Cys (C) or Tyr (Y).

Exemplary modifications provided herein include, but are not limited to, amino acid replacement in an unmodified FX polypeptide with: I at a position corresponding to position 196; S at a position corresponding to position 196; L at a position corresponding to position 196; T at a position corresponding to position 196; S at a position corresponding to position 197; S at a position corresponding to position 197; A at a position corresponding to position 197; A at a position corresponding to position 200; V at a position corresponding to position 200; S at a position corresponding to position 202; S at a position corresponding to position 211; D at a position corresponding to position 214; A at a position corresponding to position 214; S at a position corresponding to position 214; N at a position corresponding to position 215; R at a position corresponding to position 216; K at a position corresponding to position 216; A at a position corresponding to position 216; S at a position corresponding to position 216; S at a position corresponding to position 217; R at a position corresponding to position 218; K at a position corresponding to position 218; A at a position corresponding to position 218; H at a position corresponding to position 219; A at a position corresponding to position 273; E at a position corresponding to position 273; A at a position corresponding to position 276; E at a position corresponding to position 276; E at a position corresponding to position 306; S at a position corresponding to position 326; T at a position corresponding to position 326; V at a position corresponding to position 326; Q at a position corresponding to position 326; N at a position corresponding to position 326; M at a position corresponding to position 326; K at a position corresponding to position 326; Y at a position corresponding to position 326; E at a position corresponding to position 326; D at a position corresponding to position 326; A at a position corresponding to position 327; L at a position corresponding to position 327; A at a position corresponding to position 332; D at a position corresponding to position 332; E at a position corresponding to position 332; S at a position corresponding to position 332; G at a position corresponding to position 332; A at a position corresponding to position 334; T at a position corresponding to position 334; N at a position corresponding to position 334; E at a position corresponding to position 336; A at a position corresponding to position 338; S at a position corresponding to position 338; N at a position corresponding to position 338; R at a position corresponding to position 338; V at a position corresponding to position 338; Y at a position corresponding to position 338; M at a position corresponding to position 338; A at a position corresponding to position 420; E at a position corresponding to position 420; A at a position corresponding to position 424; and/or E at a position corresponding to position 424, each with reference to amino acid positions set forth in SEQ ID NO:134. The modified FX polypeptide can contain one, two, three, four, five, six, seven, eight, nine, ten or more of any of the above amino acid replacement(s), whereby each replacement is at a different position, so long as the resulting modified FX polypeptide, when in active form, exhibits increased cofactor dependence and retains FVa-dependent catalytic activity. Such modified FX polypeptides include those that exhibit at least 2-fold increased cofactor dependence, when in active form, compared to the unmodified FXa polypeptide not containing the modification(s). With reference to the amino acid residues set forth in SEQ ID NO:134, such non-limiting amino acid replacement(s) in a modified FX polypeptide provided herein are set forth in Tables 5 and 6.

not containing the modification(s) and retains FVa-dependent catalytic activity. For example, further modifications include any further modification(s) described herein to increase resistance to inhibitors, such as to AT-Ill (e.g. Section D.3) and/or for altering glycosylation (e.g. Section D.1). Exemplary amino acid replacement(s) to introduce a non-native glycosylation site include, but are not limited to, amino acid replacement(s) in an unmodified FX polypeptide with: N at a position corresponding to position 51; N at a position corresponding to position 56 and S at a position corresponding to position 58; N at a position corresponding to position 62 and S at a position corresponding to position 64; N at a position corresponding to position 65 and S at a position corresponding to position 67; N at a position corresponding to position 67; N at a position corresponding to position 73 and S at a position corresponding to position 75; N at a position corresponding to position 75 and S at a position corresponding to position 77; N at a position corresponding to position 77 and S at a position corresponding to position 79; N at a position corresponding to position 78 and S at a position corresponding to position 80; S at a position corresponding to position 82; N at a position corresponding to position 83; N at a position corresponding to position 82 and S at a position corresponding to position 84; N at a position corresponding to position 85 and S at a position corresponding to position 87; N at a position corresponding to position 86 and S at a position corresponding to position 88; N at a position corresponding to position 95 and S at a position corresponding to position 97; N at a position corresponding to position 114; N at a position corresponding to position 119 and S at a position corresponding to position 121; S at a position corresponding to position 122; N at a position corresponding to position 215 and S at a position corresponding to position 217; N at a position corresponding to position 243 and S at a position corresponding to position 245; N at a position corresponding to position 264 and S at a position corresponding to position 266; N at a position corresponding to position 293 and S at a position corresponding to position 295; N at a position corresponding to position 388; N at a position corresponding to position 389 and S at a position corresponding to position 391; N at a position corresponding to position 428 and S at a position corresponding to position 430 and/or N at a position

TABLE 5

| | | | | | | | |
|---|---|---|---|---|---|---|---|
| V196I | V196S | V196L | V196T | G197S | G197A | E200A | |
| E200V | K202S | L211S/G219H | N214D | N214A | N214S | E215N | |
| E216R | E216K | E216A | E216S | N217S | E218R | E218K | |
| E218A | T327A/K338A | R273A | R273E | K276A | K276E | R306E | |
| R326S | R326T | R326V | R326Q | R326N | R326M | R326K | |
| R326Y | R326E | R326D | T327A | T327L | R332A | R332D | |
| R332G | S334A | S334T | S334N | R336E | K338A | K338S | |
| K338N | K338R | K338V | K338Y | K338M | K420A | K420E | |
| K424A | K424E | E200V/T327L/ K338M | E220V/T327L/ S334A/K338M | V196S/L211S/ G219H | G197A/L211S/ G219H | I195L/L211S/ G219H | |
| V196S/E216K | V196S/E216A | V196S/E216S | V196S/E218R | V196S/E218K | V196S/E218A | V196S/R332A | |
| V196S/R332D | V196S/R332E | V196S/R332S | V196S/R332G | V196S/R326D | V196S/R326M | V196S/R326N | |
| V196S/R326Q | V196S/R273E | V196S/R273A | V196S/R424E | V196S/K420A | V196S/K420E | V196S/R306E | |
| V196S/N214D | V196S/N214A | V196S/N214S | V196S/E216R | V196S/K276A | V196S/K276E | V196S/K420E/ R424E | |
| V196S/K338A | V196S/K338S | T327A/K338A | | | | | |

Further amino acid replacement(s) can also be included in the modified FX polypeptides provided herein and can be any other amino acid replacement described herein or known in the art, so long as the resulting modified FX polypeptides exhibits at least a 2-fold increased cofactor dependence, when in active form, compared to the unmodified FXa polypeptide corresponding to position 429 and S at a position corresponding to position 431, each with reference to amino acid positions set forth in SEQ ID NO:134. With reference to the amino acid residues set forth in SEQ ID NO:134, such non-limiting amino acid replacement(s) in a modified FX polypeptide provided herein are set forth in Table 6.

TABLE 6

| | | | | | |
|---|---|---|---|---|---|
| L73N/G75S/ V196S | G75N/E77S/ V196S | R86N/L88S/ V196S | G114N/V196S | D95N/D97S/ V196S | E82S/V196S |
| G78N/N80S/ V196S | E77N/K79S/ V196S | D119N/G121S/ V196S | L83N/V196S | K122S/V196S | E51N/V196S |
| G114N/D119N/ G121S/V196S | D119N/G121S/ V196S/L211S/ G219H/K388N | T85N/K87S/ V196S | Q56N/Q58S/ V196S | K62N/G64S/ V196S | D119N/G121S/ V196S/L211S/ G219H |
| G114N/D119N/ G121S/V196S/ L211S/G219H | L65N/E67S V196S | E67N/V196S | V196S/E215N/ N217S | V196S/E264N/ E266S | G114N/V196S/ L211S G219H/K388N |
| D119N/G121S/ V196S/E264N/ E266S | G114N/V196S/ E264N/E266S | V196S/R429N/ L431S | V196S/R243N/ K245S | V196S/T293N/ R295S | V196S/D389N/ Y391S |
| D119N/G121S/ V196S/K388N | V196S/T428N/ G430S | V196S/L211S/ G219H/E264N/ E266S | D119N/G121S/ V196S/L211S/ G219H/E264N/ E266S | G114N/V196S/ L211S/G219H/ E264N/E266S | V196S/E264N/ E266S/K388N |
| E82N/F84S/ V196S | Q58N/K60S/ V196S | G114N/V196S/ L211S/G219H | V196S/L211S/ G219H/E264N/ E266S/K388N | V196S/K388N | |

In particular examples, modified FX polypeptides provided herein include at least one modification that is, but is not limited to, amino acid replacement in an unmodified FX polypeptide with: S at a position corresponding to position 196; T at a position corresponding to position 196; S at a position corresponding to position 197; S at a position corresponding to position 197; A at a position corresponding to position 197; A at a position corresponding to position 200; V at a position corresponding to position 200; S at a position corresponding to position 202; S at a position corresponding to position 211; D at a position corresponding to position 214; A at a position corresponding to position 214; S at a position corresponding to position 214; N at a position corresponding to position 215; R at a position corresponding to position 216; A at a position corresponding to position 216; S at a position corresponding to position 216; S at a position corresponding to position 217; R at a position corresponding to position 218; A at a position corresponding to position 218; H at a position corresponding to position 219; E at a position corresponding to position 273; E at a position corresponding to position 276; E at a position corresponding to position 306; S at a position corresponding to position 326; T at a position corresponding to position 326; V at a position corresponding to position 326; N at a position corresponding to position 326; M at a position corresponding to position 326; K at a position corresponding to position 326; Y at a position corresponding to position 326; E at a position corresponding to position 326; D at a position corresponding to position 326; A at a position corresponding to position 327; L at a position corresponding to position 327; D at a position corresponding to position 332; E at a position corresponding to position 332; S at a position corresponding to position 332; G at a position corresponding to position 332; A at a position corresponding to position 334; T at a position corresponding to position 334; N at a position corresponding to position 334; E at a position corresponding to position 336; A at a position corresponding to position 338; S at a position corresponding to position 338; N at a position corresponding to position 338; R at a position corresponding to position 338; V at a position corresponding to position 338; Y at a position corresponding to position 338; M at a position corresponding to position 338; E at a position corresponding to position 420; and/or E at a position corresponding to position 424, each with reference to amino acid positions set forth in SEQ ID NO:134.

In examples herein, modified FX polypeptides provided herein, including modified FX zymogen or FXa, have at least one amino acid replacements in an unmodified FX polypeptide that is replacement with S at a position corresponding to position 211 or replacement with H at a position corresponding to position 219 with reference to amino acid positions set forth in SEQ ID NO:134. The modified FX polypeptide can contain two, three, four, five, six, seven, eight, nine, ten or more amino acid replacement(s), whereby each replacement is at a different position, so long as the resulting modified FX polypeptide, when in active form, exhibits increased cofactor dependence and retains FVa-dependent catalytic activity. For example, modified FX polypeptides provided herein, including modified FX zymogen or FXa, have at least two amino acid replacements in an unmodified FX polypeptide that is replacement with S at a position corresponding to position 211 and replacement with H at a position corresponding to position 219 with reference to amino acid positions set forth in SEQ ID NO:134. Further amino acid replacement(s) can be any other amino acid replacement described herein or known in the art. In particular example, a further amino acid replacement is at position 195, 196, 197 or 198. Exemplary of such further amino acid replacement(s) include, but are not limited to, replacement with: L at a position corresponding to position 195; replacement with V at a position corresponding to position 195; replacement with S at a position corresponding to position 195; replacement with T at a position corresponding to position 195; replacement with I at a position corresponding to position 195; replacement with A at a position corresponding to position 195; replacement with F at a position corresponding to position 195; replacement with D at a position corresponding to position 195; replacement with G at a position corresponding to position 195; replacement with I at a position corresponding to position 196; replacement with A at a position corresponding to position 196; replacement with S at a position corresponding to position 196; replacement with L at a position corresponding to position 196; replacement with F at a position corresponding to position 196; replacement with I at a position corresponding to position 196; replacement with T at a position corresponding to position 196; replacement with G at a position corresponding to position 196; S at a position corresponding to position 197; A at a position corresponding to position 197; A at a position corresponding to position 197; N at a position corresponding to position 197; H at a position corresponding to position 197; and R at a position corresponding to position 197. In other examples, further modifications include any further modification(s) described herein to increase resistance to inhibitors, such as AT-III (Section D.3) and/or for increasing altering glycosylation (Section D.1). Such modified FX polypeptides include those that exhibit at least 2-fold increased cofactor dependence, when in active form, compared to the unmodified FXa polypeptide not containing the modification(s). With reference to the amino acid residues set forth in SEQ ID NO:134, non-limiting amino acid replacement(s) in a modified FX polypeptide provided herein is set forth in Table 7.

TABLE 7

| | | | |
|---|---|---|---|
| L211S/G219H | V196L/L211S/ G219H | G197A/L211S/ G219H | I195L/L211S/ G219H |
| D119N/G121S/ V196S/L211S/ G219H | G114N/V196S/ L211S/G219H | G114N/D119N/ G121S/V196S/ L211S/G219H | G114N/V196S/ L211S G219H/K388N |
| V196S/L211S/ G219H/E264N/ E266S/K388N | V196S/L211S/ G219H/E264N/ E266S | D119N/G121S/ V196S/L211S/ G219H/E264N/ E266S | G114N/V196S/ L211S/G219H/ E264N/E266S |
| D119N/G121S/ V196S/L211S/ G219H/K388N | | | |

In particular examples herein, modified FX polypeptides provided herein, including modified FX zymogen or FXa, have at least one amino acid replacement in an unmodified FX polypeptide that is replacement with S at a position corresponding to position 196; L at a position corresponding to position 196; T at a position corresponding to position 196; S at a position corresponding to position 197; A at a position corresponding to position 197; A at a position corresponding to position 200; V at a position corresponding to position 200; S at a position corresponding to position 202; A at a position corresponding to position 338; S at a position corresponding to position 338; or V at a position corresponding to position 338, each with reference to amino acid positions set forth in SEQ ID NO:134: The modified FX polypeptide can contain two, three, four, five, six, seven, eight, nine, ten or more amino acid replacement(s), whereby each replacement is at a different position, so long as the resulting modified FX polypeptide, when in active form, exhibits increased cofactor dependence and retains FVa-dependent catalytic activity. Further amino acid replacement(s) can be any other amino acid replacement described herein or known in the art. For example, further modifications include any further modification(s) described herein above that increase cofactor independence, any that increase resistance to inhibitors, such as AT-III (Section D.3) and/or any for that alter glycosylation (Section D.1). Such modified FX polypeptides include those that exhibit at least 10-fold increased cofactor dependence, when in active form, compared to the unmodified FXa polypeptide not containing the modification(s). With reference to the amino acid residues set forth in SEQ ID NO:134, such non-limiting amino acid replacement(s) in a modified FX polypeptide provided herein are set forth in Table 8 and Table 9.

TABLE 8

| | | | | |
|---|---|---|---|---|
| V196S | V196T | V196L | V196T | G197S |
| K202S | K338A | K338S | K338V | T327A/K338A |
| E200V/T327L/ S334A/K338M | G197A/L211/ G219H | | | |

In particular examples, modified FX polypeptides provided herein, including modified FX zymogen or FXa, that exhibit increased cofactor dependence in their active form have at least one amino acid replacement in an unmodified FX polypeptide at amino acid position 196 to a polar, neutral or hydrophilic amino acid residue. Hence, modified FX polypeptides provided herein contain at least one amino acid modification, such as at least one amino acid replacement, that is replacement with N, Q, S, T, W, C, or Y at a position corresponding to position 196 with reference to the sequence of amino acids set forth in SEQ ID NO:134. Such modified FX polypeptides provided herein include those that exhibit at least 2-fold, 5-fold, 10-fold, 20-fold, 30-fold, 40-fold, and generally at least 50-fold, such as at least 100-fold or more, increased co-factor dependence, when in active form, compared to the unmodified FXa polypeptide not containing the modification(s). Exemplary of such a modified FX polypeptide provided herein is a FX polypeptide, including a modified FX zymogen or FXa, that contains at least one amino acid replacement that is replacement with S at a position corresponding to position 196. The modified FX polypeptide can contain two, three, four, five, six, seven, eight, nine, ten or more amino acid replacement(s), whereby each replacement is at a different position, so long as the resulting modified FX polypeptide, when in active form, exhibits at least 2-fold, 5-fold, 10-fold, 20-fold, 30-fold, 40-fold, and generally at least 50-fold, such as at least 100-fold or more, increased cofactor dependence and retains FVa-dependent catalytic activity. Further amino acid replacement(s) can be any other amino acid replacement described herein or known in the art. For example, further modifications include any further modification(s) described herein above that increase cofactor independence, any that increase resistance to inhibitors, such as AT-III (Section D.3) and/or any for altering glycosylation (Section D.1). With reference to the amino acid residues set forth in SEQ ID NO:134, such non-limiting amino acid replacement(s) in a modified FX polypeptide provided herein are set forth in Table 9.

TABLE 9

| | | | | |
|---|---|---|---|---|
| V196S | V196S/L211S/ G219H | V196S/N214D | V196S/N214A | V196S/N214S |
| V196S/E216R | V196S/E216K | V196S/E216A | V196S/E216S | V196S/E216S |
| V196S/E218R | V196S/E218K | V196S/E218A | V196S/R332A | V196S/R332D |
| V196S/R332E | V196S/R332S | V196S/R332G | V196S/R326D | V196S/R326M |
| V196S/R326N | V196S/R326Q | V196S/R273E | V196S/R273A | V196S/R424A |
| V196S/R424E | V196S/K420A | V196S/K420E | V196S/R306E | V196S/K276A |
| V196S/K276E | V196S/K338A | V196S/K338S | E82S/V196S | E82N/F84S/ V196S |
| L73N/G75S/ V196S | G75N/E77S/ V196S | R86N/L88S/ V196S | G114N/V196S | D95N/D97S/ V196S |
| G78N/N80S/ V196S | E77N/K79S/ V196S | D119N/G121S/ V196S | L83N/V196S | K122S/V196S |
| E51N/V196S | Q58N/K60S/ V196S | G114N/D119N/ G121S/V196S | D119N/G121S/ V196S/L211S/ G219H/K388N | T85N/K87S/ V196S |

TABLE 9-continued

| | | | | |
|---|---|---|---|---|
| Q56N/Q58S/ V196S | K62N/G64S/ V196S | D119N/G121S/ V196S/L211S/ G219H | G114N/V196S/ L211S/G219H | G114N/D119N/ G121S/V196S/ L211S/G219H |
| L65N/E67S V196S | E67N/V196S | V196S/E215N/ N217S | V196S/E264N/ E266S | G114N/V196S/ L211S G219H/K388N |
| V196S/L211S/ G219H/E264N/ E266S/K388N | D119N/G121S/ V196S/E264N/ E266S | G114N/V196S/ E264N/E266S | V196S/R429N/ L431S | V196S/R243N/ K245S |
| V196S/T293N/ R295S | V196S/D389N/ Y391S | V196S/K388N | D119N/G121S/ V196S/K388N | V196S/T428N/ G430S |
| V196S/L211S/ G219H/E264N/ E266S | D119N/G121S/ V196S/L211S/ G219H/E264N/ E266S | G114N/V196S/ L211S/G219H/ E264N/E266S | V196S/E264N/ E266S/K388N | V196S/K420E/ R424E |
| V196S/E215N/ N217S | | | | |

3. Increased Resistance to Inhibitors

Provided herein are modified FX polypeptides, including modified FX zymogen and modified FXa polypeptides, that contain one or more modification(s) in a FX polypeptide and that, when in active FXa form, exhibit increased resistance to inhibition by an FX inhibitor. FX inhibitors include, for example, tissue factor pathway inhibitor (TFPI) and antithrombin III (AT-III). The modifications can be insertions, deletion or replacement of amino acids. In particular, the modifications are amino acid replacements.

TFPI is a Kunitz-type inhibitor. TFPI has a precursor sequence of amino acids set forth in SEQ ID NO:557 and has a mature sequence corresponding to residues set forth as 29-304 of SEQ ID NO: 557. TFPI is trivalent and contains three Kunitz-type domains. TFPI directly inhibits FXa throughout its second Kunitz domain (corresponding to residues 125-175 of the sequence set forth in SEQ ID NO:557). TFPI also is able to inhibit the factor VIIa/tissue (TF) complex, after FXa is bound, via its first Kunitz domain (corresponding to residues 54-104 in the sequence set forth in SEQ ID NO:557). Inhibition by TFPI is greater in the presence of phospholipids and FVa. Like ATIII below, the activity of TFPI is mediated via active site binding interactions with FXa. Included among modified FX polypeptides provided herein, such as modified FX polypeptides that are zymogen-like polypeptides, are those that exhibit increased resistance to TFPI because the binding interactions are altered and/or not accessible to inhibition by TFPI.

AT-III is an anticoagulant serpin (serine protease inhibitor). AT-III is synthesized as a precursor protein containing 464 amino acid residues (see SEQ ID NO:553). In the course of secretion, a 32 residue signal peptide is cleaved to generate a 432 amino acid mature human antithrombin (SEQ ID NO:554). The 58 kDa AT-III glycoprotein circulates in the blood and functions as a serine protease inhibitor (serpin) to inhibit a large number of serine proteases of the coagulation system. The principal targets of AT-III are thrombin and factor Xa, although AT-III also has been shown to inhibit the activities of FIXa, FXIa, FXIIa and, to a lesser extent, FVIIa (see e.g. FIGS. 2A-2B).

The action of AT-III is greatly enhanced by glycosaminoglycans, such as the naturally occurring heparan sulphate or the various tissue-derived heparins that are widely used as anticoagulants in clinical practice. AT-III binds in a highly specific manner to a unique pentasaccharide sequence in heparin that induces a conformational change in the reactive center loop (RCL). In such a conformation, the reactive center loop of AT-III can more efficiently interact with the reactive site of the serine protease, and effect inhibition. This "activation" of the AIII RCL can be induced by the specific pentasaccharide itself as well as by other "low molecule weight" forms of heparin and also by high molecular weight forms of heparin. The long chain heparin (or "high molecular weight" heparin), which has binding sites on both AT-Ill and FXa, also acts as a template for AT-III and FXa, thereby bringing them into close proximity and further facilitating the inhibitory interaction. In the absence of heparin, AT-III is a relatively ineffective inhibitor of FXa (Quinsey et al. (2002) *J. Biol. Chem.*, 277:15971-15978).

AT-III specifically interacts with FXa and not the FX zymogen form. The conformation switch that occurs upon cleavage of the Arg194-Ile195 bond (Arg15-Ile16 by chymotrypsin numbering) structurally exposes the exosites required for AT-III and heparin interactions. AT-III interaction with FXa is mediated or enhanced by extended substrate binding site residues in exosite 1, and specifically glutamic acid residues 215, 216 and 219 by mature numbering (corresponding to residues 36, 37 and 39 by chymotrypsin numbering)(see e.g. Quinsey et al. (2002) and Bianchini et al. (2004) *J Biol. Chem.*, 279:3671-3679). The heparin-binding exosite of FXa is topologically located on the opposite side of exosite 1, and includes residues Arg273, Lys 276, Arg306, Arg347, Lys351, Lys420 and Arg424 by mature numbering set forth in SEQ ID NO:134 (corresponding to Arg93, Lys96, Arg125, Arg165, Lys169, Lys236 and Arg240, by chymotrypsin numbering) (see e.g. Rezaie (2000) *J. Biol. Chem.*, 275:3320-7). In addition, basic residues of the autolysis loop 326-336 (corresponding to residues 143-154 by chymotrypsin numbering) also play a role in recognition of the heparin-activated conformation of AT-III by FXa (Rezaie et al. (2005)*J Biol. Chem.*, 280:32722-32728; Bianchini et al. (2004)

Increased resistance to inhibitors, including TFPI or AT-III can be achieved by modifying one or more residues in a FX polypeptide associated with inhibitor (e.g. AT-III or TFPI) interaction. Also, increased resistance can be achieved by modifying one or more residues involved in heparin interactions. For example, one or more residues in exosite 1, the autolysis loop or in the heparin-binding exosite can be modified. In addition, modification(s) that render the FXa polypeptide more zymogen-like, thereby conformationally perturbing access to the above binding sites, also can confer increased resistance to inhibitors. Hence, modification(s) to increase resistance to inhibitors (e.g. ATM or TFPI) also can occur in one or more residues of the activation domain corresponding to residues 195-198, 325-334, 366-377 and 400-406 by mature numbering with reference to SEQ ID NO:134 (corresponding to residues 16-19, 142

223 by chymotrypsin numbering) and/or residues 211, 219 or 378 to form a zymogen triad (see e.g. Section D.2 above).

For example, modified FX polypeptides provided herein, when in active FXa form, exhibit increased resistance to inhibitors (e.g. AT-III or TFPI) compared to the unmodified FXa not containing the modification(s) of at least 2-fold, such as at least 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold, 1500-fold, 2000-fold, 2500-fold, 3000-fold, 3500-fold, 4000-fold, 4500-fold, 5000-fold, 5500-fold, 6000-fold or more. Thus, when evaluated in an appropriate in vitro, in vivo, or ex vivo assay, the modified FX polypeptides can display increased resistance to inhibitors (e.g. AT-III or TFPI) compared with that of the unmodified FX polypeptides.

Included among such modified FX polypeptides are those that contain a modification(s) at amino acid residue(s) 196, 197, 200, 202, 211, 214, 216, 218, 219, 273, 276, 306, 326, 327, 332, 334, 336, 338, 420 and/or 424 in the heavy chain of a FX corresponding to residues set forth in SEQ ID NO:134. Generally, the modification is an amino acid replacement. The amino acid replacement can be to any of the other 19 amino acids at that position so long as the resulting modified FX polypeptide, when in active form, exhibits increased resistance to inhibitors (e.g. AT-III or TFPI) compared to the FXa not containing the amino acid replacement(s) and retains FVa-dependent catalytic activity.

In particular examples, modification(s) to effect resistance to inhibitors can be modifications that render the FXa polypeptide more zymogen-like, thereby reducing the rate of inhibitor binding (e.g. AT-III binding or TFPI binding). For example, modified FX polypeptides that exhibit increased resistance to inhibitors (e.g. AT-III or TFPI) can contain at least one amino acid modification(s), such as at least one amino acid replacement(s), at a position corresponding to position 195, 196, 197, or 198 with reference to positions set forth in SEQ ID NO:134 (position 16-19 by chymotrypsin numbering). These amino acid residues correspond to the hydrophobic residues at the new N-terminus that is created upon activation cleavage of the FX zymogen. As discussed elsewhere herein, following "activation cleavage" hydrophobic residues at the N-terminus insert into the activation pocket" and the new α-ammonium of Ile195 forms a salt bridge with residue Asp378 (corresponding to Asp 194 by chymotrypsin numbering) that is necessary for the transition from the inactive to the active state. For example, the Val residue that is present in the exemplary FX polypeptide set forth in SEQ ID NO:134 is hydrophobic and is suited for optimal interaction within the activation pocket. In particular examples, modification by amino acid replacement(s) of N-terminal amino acid residues 195, 196, 197 and/or 198 (corresponding to residues 16-19 by chymotrypsin numbering) to a hydrophilic neutral amino acid residues that contains a polar R group disrupt or destabilize this a salt bridge formation or other "coupled" conformational changes described above, while still retaining activity. Exemplary of such amino acid residues are Asn (N), Gln (Q), Ser (S), Thr (T), Cys (C) or Tyr (Y).

In examples herein, modifications provided herein that confer increased resistance to inhibitors (e.g. AT-III or TFPI) include, but are not limited to, amino acid replacement in an unmodified FX polypeptide with: I at a position corresponding to position 196; S at a position corresponding to position 196; L at a position corresponding to position 196; T at a position corresponding to position 196; S at a position corresponding to position 197; A at a position corresponding to position 197; A at a position corresponding to position 200; V at a position corresponding to position 200; S at a position corresponding to position 200; S at a position corresponding to position 202; S at a position corresponding to position 211; D at a position corresponding to position 214; A at a position corresponding to position 214; S at a position corresponding to position 214; R at a position corresponding to position 216; K at a position corresponding to position 216; A at a position corresponding to position 216; S at a position corresponding to position 216; R at a position corresponding to position 218; K at a position corresponding to position 218; A at a position corresponding to position 218; H at a position corresponding to position 219; A at a position corresponding to position 273; E at a position corresponding to position 273; A at a position corresponding to position 276; E at a position corresponding to position 276; E at a position corresponding to position 306; A at a position corresponding to position 326; S at a position corresponding to position 326; T at a position corresponding to position 326; V at a position corresponding to position 326; Q at a position corresponding to position 326; N at a position corresponding to position 326; M at a position corresponding to position 326; K at a position corresponding to position 326; Y at a position corresponding to position 326; E at a position corresponding to position 326; D at a position corresponding to position 326; A at a position corresponding to position 327; L at a position corresponding to position 327; A at a position corresponding to position 332; D at a position corresponding to position 332; E at a position corresponding to position 332; S at a position corresponding to position 332; G at a position corresponding to position 332; A at a position corresponding to position 334; T at a position corresponding to position 334; N at a position corresponding to position 334; E at a position corresponding to position 336; A at a position corresponding to position 338; S at a position corresponding to position 338; N at a position corresponding to position 338; R at a position corresponding to position 338; V at a position corresponding to position 338; Y at a position corresponding to position 338; M at a position corresponding to position 338; A at a position corresponding to position 420; E at a position corresponding to position 420; A at a position corresponding to position 424; and/or E at a position corresponding to position 424, each with reference to amino acid positions set forth in SEQ ID NO:134. The modified FX polypeptide can contain one, two, three; four, five, six, seven, eight, nine, ten or more of any of the above amino acid replacement(s), whereby each replacement is at a different position, so long as the resulting modified FX polypeptide, when in active form, exhibits increased inhibitor resistance (e.g. AT-III resistance and/or TFPI resistance) and retains FVa-dependent catalytic activity. Such modified FX polypeptides include those that exhibit at least 2-fold increased inhibitor resistance (e.g. AT-In resistance and/or TFPI resistance), when in active form, compared to the unmodified FXa polypeptide not containing the modification(s). With reference to the amino acid residues set forth in SEQ ID NO:134, such non-limiting amino acid replacement(s) in a modified FX polypeptide provided herein are set forth in Tables 10-13.

TABLE 10

| V196I | V196S | V196L | V196T | G197S | E200A | E200V |
|---|---|---|---|---|---|---|
| K202S | L211S/G219H | R326Y | R326A | R326T | R326V | R326Q |
| R326N | R326M | R326K | T327A | T327L | S334A | S334T |
| S334N | R336E | K338A | K338S | K338N | K338R | K338V |

TABLE 10-continued

| | | | | | | |
|---|---|---|---|---|---|---|
| K338Y | K338M | T327A/K338A | T327L/K338M | E200V/T327L/ K338M | E220V/T327L/ S334A/K338M | V196S/L211S/ G219H |
| G197A/L211S/ G219H | I195L/L211S/ G219H | V196S/N214D | V196S/N214A | V196S/N214S | V196S/E216R | |
| V196S/E216K | V196S/E216A | V196S/E216S | V196S/E218R | V196S/E218K | V196S/E218A | V196S/R332A |
| V196S/R332D | V196S/R332E | V196S/R332S | V196S/R332G | V196S/R326D | V196S/R326M | V196S/R326N |
| V196S/R326Q | V196S/R273E | V196S/R273A | V196S/R424E | V196S/K420A | V196S/K420E | V196S/R306E |
| V196S/R424A | V196S/K338A | V196S/K338S | V196S/K276A | V196S/K276E | V196S/K420E/ R424E | |

Further amino acid replacement(s) can also be included in the modified FX polypeptides provided herein and can be any other amino acid replacement described herein or known in the art, so long as the resulting modified FX polypeptides exhibits at least a 2-fold increased inhibitor resistance (e.g. AT-III resistance and/or TFPI resistance), when in active form, compared to the unmodified FXa polypeptide not containing the modification(s) and retains FVa-dependent catalytic activity. For example, further modifications include any further modification(s) described herein to increase cofactor dependence (e.g. Section D.2) and/or for altering glycosylation (e.g. Section D.1). Exemplary amino acid replacement(s) to introduce a non-native glycosylation site include, but are not limited to, amino acid replacement(s) in an unmodified FX polypeptide with: N at a position corresponding to position 51; N at a position corresponding to position 56 and S at a position corresponding to position 58; N at a position corresponding to position 62 and S at a position corresponding to position 64; N at a position corresponding to position 65 and S at a position corresponding to position 67; N at a position corresponding to position 67; N at a position corresponding to position 73 and S at a position corresponding to position 75; N at a position corresponding to position 75 and S at a position corresponding to position 77; N at a position corresponding to position 77 and S at a position corresponding to position 79; N at a position corresponding to position 78 and S at a position corresponding to position 80; S at a position corresponding to position 82; N at a position corresponding to position 83; N at a position corresponding to position 82 and S at a position corresponding to position 84; N at a position corresponding to position 85 and S at a position corresponding to position 87; N at a position corresponding to position 86 and S at a position corresponding to position 88; N at a position corresponding to position 95 and S at a position corresponding to position 97; N at a position corresponding to position 114; N at a position corresponding to position 119 and S at a position corresponding to position 121; S at a position corresponding to position 122; N at a position corresponding to position 215 and S at a position corresponding to position 217; N at a position corresponding to position 243 and S at a position corresponding to position 245; N at a position corresponding to position 264 and S at a position corresponding to position 266; N at a position corresponding to position 293 and S at a position corresponding to position 295; N at a position corresponding to position 388; N at a position corresponding to position 389 and S at a position corresponding to position 391; N at a position corresponding to position 428 and S at a position corresponding to position 430 and/or N at a position corresponding to position 429 and S at a position corresponding to position 431, each with reference to amino acid positions set forth in SEQ ID NO:134. With reference to the amino acid residues set forth in SEQ ID NO:134, such non-limiting amino acid replacement(s) in a modified FX polypeptide provided herein are set forth in Table 11.

TABLE 11

| | | | | | |
|---|---|---|---|---|---|
| T85N/K87S/ V196S | Q56N/Q58S/ V196S | K62N/G64S/ V196S | L65N/E67S/ V196S | E67N/V196S | L73N/G75S/ V196S |
| G75N/E77S/ V196S | R86N/L88S/ V196S | G114N/V196S | D95N/D97S/ V196S | E82S/V196S | E82N/F84S/ V196S |
| G78N/N80S/ V196S | E77N/K79S/ V196S | D119N/G121S/ V196S | L83N/V196S | K122S/V196S | E51N/V196S |
| Q58N/K60S/ V196S | G114N/D119N/ G121S/V196S | D119N/G121S/ V196S/L211S/ G219H | G114N/V196S/ L211S/G219H | G114N/D119N/ G121S/V196S/ L211S/G219H | V196S/E215N/ N217S |
| V196S/E264N/ E266S | D119N/G121S/ V196S/E264N/ E266S | G114N/V196S/ E264N/E266S | V196S/R429N/ L431S | V196S/R243N/ K245S | V196S/T239N/ R295S |
| V196S/D389N/ Y391S | V196S/K388N | D119N/G121S/ V196S/K388N | V196S/T428N/ G430S | V196S/L211S/ G219H/E264N/ E266S | D119N/G121S/ V196S/L211S/ G219H/E264N/ E266S |
| | G114N/V196S/ L211S/G219H/ E264N/E266S | V196S/E264N/ E266S/K388N | D119N/G121S/ V196S/L211S/ G219H/K388N | G114N/V196S/ L211S/G219H/ K388N | V196S/L211S/ G219H/E264N/ E266S/K388N |

In particular examples, modifications provided herein include, but are not limited to, amino acid replacement in an unmodified FX polypeptide with: S at a position corresponding to position 196; T at a position corresponding to position 196; S at a position corresponding to position 197; A at a position corresponding to position 197; A at a position corresponding to position 200; V at a position corresponding to position 200; S at a position corresponding to position 200; S at a position corresponding to position 202; S at a position corresponding to position 211; D at a position corresponding to position 214; A at a position corresponding to position 214; S at a position corresponding to position 214; R at a position corresponding to position 216; K at a position corresponding to position 216; A at a position corresponding to position 216; S at a position corresponding to position 216; R at a position corresponding to position 218; A at a position corresponding to position 218; H at a position corresponding to position 219; E at a position corresponding to position 273; E at a position corresponding to position 276; E at a position corresponding to position 306; S at a position corresponding to position 326; T at a position corresponding to position 326; V at a position corresponding to position 326; N at a position corresponding to position 326; M at a position corresponding to position 326; K at a position corresponding to position 326; Y at a position corresponding to position 326; E at a position corresponding to position 326; D at a position corresponding to position 326; A at a position corresponding to position 327; L at a position corresponding to position 327; D at a position corresponding to position 332; E at a position corresponding to position 332; S at a position corresponding to position 332; G at a position corresponding to position 332; A at a position corresponding to position 334; T at a position corresponding to position 334; N at a position corresponding to position 334; E at a position corresponding to position 336; A at a position corresponding to position 338; S at a position corresponding to position 338; N at a position corresponding to position 338; R at a position corresponding to position 338; V at a position corresponding to position 338; Y at a position corresponding to position 338; M at a position corresponding to position 338; E at a position corresponding to position 420; and/or E at a position corresponding to position 424, each with reference to amino acid positions set forth in SEQ ID NO:134.

In examples herein, modified FX polypeptides provided herein, including modified FX zymogen or FXa, have at least one amino acid replacement in an unmodified FX polypeptide that is replacement with S at a position corresponding to position 211 or replacement with H at a position corresponding to position 219 with reference to amino acid positions set forth in SEQ ID NO:134. The modified FX polypeptide can contain two, three, four, five, six, seven, eight, nine, ten or more amino acid replacement(s), whereby each replacement is at a different position, so long as the resulting modified FX polypeptide, when in active form, exhibits increased resistance to inhibitor (e.g. AT-III or TFPI) and retains FVa-dependent catalytic activity. For example, modified FX polypeptides provided herein, including modified FX zymogen or FXa, have at least two amino acid replacements in an unmodified FX polypeptide that is replacement with S at a position corresponding to position 211 and replacement with H at a position corresponding to position 219 with reference to amino acid positions set forth in SEQ ID NO:134. Further amino acid replacement(s) can be any other amino acid replacement described herein or known in the art. In particular example, a further amino acid replacement is at position 195, 196, 197 or 198. Exemplary of such further amino acid replacement(s) include, but are not limited to, replacement with: L at a position corresponding to position 195; replacement with V at a position corresponding to position 195; replacement with S at a position corresponding to position 195; replacement with T at a position corresponding to position 195; replacement with I at a position corresponding to position 195; replacement with A at a position corresponding to position 195; replacement with F at a position corresponding to position 195; replacement with D at a position corresponding to position 195; replacement with G at a position corresponding to position 195; replacement with I at a position corresponding to position 196; replacement with A at a position corresponding to position 196; replacement with S at a position corresponding to position 196; replacement with L at a position corresponding to position 196; replacement with F at a position corresponding to position 196; replacement with I at a position corresponding to position 196; replacement with T at a position corresponding to position 196; replacement with G at a position corresponding to position 196; S at a position corresponding to position 197; A at a position corresponding to position 197; A at a position corresponding to position 197; N at a position corresponding to position 197; H at a position corresponding to position 197; and/or R at a position corresponding to position 197. In other examples, further modifications include any further modification(s) described herein to increase cofactor dependence (e.g. Section D.2) and/or for altering glycosylation (e.g. Section D.1). Such modified FX polypeptides include those that exhibit at least 2-fold or more increased resistance to inhibitor and/or increased cofactor dependence, when in active form, compared to the unmodified FXa polypeptide not containing the modification(s). With reference to the amino acid residues set forth in SEQ ID NO:134, such non-limiting amino acid replacement(s) in a modified FX polypeptide provided herein are set forth in Table 12.

TABLE 12

| V196S/L211S/ G219H | G197A/L211S/ G219H | I195L/L211S/ G219H | D119N/G121S/ V196S/L211S/ G219H | G114N/V196S/ L211S/G219H | G114N/D119N/ G121S/V196S/ L211S/G219H |
|---|---|---|---|---|---|
| V196S/L211S/ G219H/E264N/ E266S | D119N/G121S/ V196S/L211S/ G219H/E264N/ E266S | G114N/V196S/ L211S/G219H/ E264N/E266S | D119N/G121S/ V196S/L211S/ G219H/K388N | G114N/V196S/ L211S/G219H/ K388N | V196S/L211S/ G219H/E264N/ E266S/K388N |

In particular examples herein, modified FX polypeptides provided herein, including modified FX zymogen or FXa, that exhibit increased inhibitor resistance (e.g. AT-III resistance and/or TFPI resistance) in their active form have at least one amino acid replacement in an unmodified FX polypeptide that is replacement with S at a position corresponding to position 196; L at a position corresponding to position 196; T at a position corresponding to position 196; S at a position corresponding to position 197; N at a position corresponding to position 326; A at a position corresponding to position 334; T at a position corresponding to position 334; A at a position corresponding to position 338; S at a position corresponding to position 338; or V at a position corresponding to position 338, each with reference to amino acid positions set forth in SEQ ID NO:134. The modified FX polypeptide can contain one, two, three, four, five, six, seven, eight, nine, ten or more amino acid replacement(s), whereby each replacement is at a different position, so long as the resulting modified FX polypeptide, when in active form, exhibits increased inhibitor resistance (e.g. AT-III resistance and/or TFPI resistance) and retains FVa-dependent catalytic activity. Further amino acid replacement(s) can be any other amino acid replacement described herein or known in the art. For example, further modifications include any further modification(s) described herein above that increase cofactor independence (Section D.2) and/or any that alter glycosylation (Section D.1). Such modified FX polypeptides include those that exhibit at least 5-fold increased cofactor dependence, such as at least 10-fold, 20-fold, 30-fold, 40-fold, 50-fold, 60-fold, 70-fold, 80-fold, 90-fold, 100-fold or more increased cofactor dependence when in active form, compared to the unmodified FXa polypeptide not containing the modification(s).

In particular examples, modified FX polypeptides provided herein, including modified FX zymogen or FXa, that exhibit increased inhibitor resistance (e.g. AT-III resistance and/or TFPI resistance) in their active form have at least two amino acid replacement(s) in an unmodified FX polypeptide, where one replacement is at amino acid position 195, 196, 197 or 198 and the other replacement is a replacement at a position corresponding to one or more of positions 273, 276, 306, 326, 332, 338, 420 and/or 424. The replacement can be to any of the other 19 amino acids at the position. Exemplary non-limiting replacement at amino acid position 195, 196, 197 or 198 is to a polar, neutral or hydrophilic amino acid residue, such as a replacement at position 195 or 196 with Asn (N), Gln (Q), Ser (S), Thr (T), Cys (C), or Tyr (Y), for example replacement with S or T. Exemplary non-limiting replacement at a position corresponding to one or more of positions 273, 276, 306, 326, 332, 338, 420 and/or 424 is to an acidic or neutral amino acid residue, such as to Asp (D), Glu (E), Ala (A), Gly (G), Ser (S), Cys (C), Asn (N), Gln (Q), Ile (I), Leu (L), Met (M), Phe (F), Pro (P), Thr (T), Trp (W), Tyr (Y) or Val (V), for example replacement with A or E. Such modified FX polypeptides containing at least two replacements at position 195, 196, 197 and/or 198 and at one or more of positions 273, 276, 306, 326, 332, 338, 420 and/or 424 include those that exhibit at least 2-fold, 4-fold, 10-fold, 50-fold, 100-fold, 200-fold, 300-fold, 400-fold, and in particular at least 500-fold increased inhibitor resistance (e.g. AT-III resistance and/or TFPI resistance), when in active form, compared to the unmodified FXa polypeptide not containing the modification(s).

In particular examples, modified FX polypeptides provided herein, including modified FX zymogen or FXa have at least two amino acid replacement(s) in an unmodified FX polypeptide where:

1) at least one is replacement corresponding to replacement with: L at a position corresponding to position 195; replacement with V at a position corresponding to position 195; replacement with S at a position corresponding to position 195; replacement with T at a position corresponding to position 195; replacement with I at a position corresponding to position 195; replacement with A at a position corresponding to position 195; replacement with F at a position corresponding to position 195; replacement with D at a position corresponding to position 195; replacement with G at a position corresponding to position 195; replacement with I at a position corresponding to position 196; replacement with A at a position corresponding to position 196; replacement with S at a position corresponding to position 196; replacement with L at a position corresponding to position 196; replacement with F at a position corresponding to position 196; replacement with I at a position corresponding to position 196; replacement with T at a position corresponding to position 196; replacement with G at a position corresponding to position 196; S at a position corresponding to position 197; A at a position corresponding to position 197; A at a position corresponding to position 197; N at a position corresponding to position 197; H at a position corresponding to position 197; and/or R at a position corresponding to position 197; and 2) at least one is replacement corresponding to replacement with: A at a position corresponding to position 273; E at a position corresponding to position 273; A at a position corresponding to position 276; E at a position corresponding to position 276; E at a position corresponding to position 306; A at a position corresponding to position 326; S at a position corresponding to position 326; T at a position corresponding to position 326; V at a position corresponding to position 326; Q at a position corresponding to position 326; N at a position corresponding to position 326; M at a position corresponding to position 326; K at a position corresponding to position 326; Y at a position corresponding to position 326; E at a position corresponding to position 326; D at a position corresponding to position 326; A at a position corresponding to position 332; D at a position corresponding to position 332; E at a position corresponding to position 332; S at a position corresponding to position 332; G at a position corresponding to position 332; A at a position corresponding to position 338; S at a position corresponding to position 338; N at a position corresponding to position 338; R at a position corresponding to position 338; V at a position corresponding to position 338; Y at a position corresponding to position 338; M at a position corresponding to position 338; A at a position corresponding to position 420; E at a position corresponding to position 420; A at a position corresponding to position 424; and/or E at a position corresponding to position 424, each with reference to amino acid positions set forth in SEQ ID NO:134. With reference to the amino acid residues set forth in SEQ ID NO:134, such non-limiting amino acid replacement(s) in a modified FX polypeptide provided herein are set forth in Table 13.

TABLE 13

| V196S/R332D | V196S/R332E | V196S/R332S | V196S/R332G | V196S/R326D | V196S/R326M |
|---|---|---|---|---|---|
| V196S/R326Q | V196S/R273E | V196S/R273A | V196S/R424E | V196S/K420A | V196S/K420E |
| V196S/R424A | V196S/K338A | V196S/K338S | V196S/K276A | V196S/K276E | V196S/K420E/ R424E |
| V196S/R326N | V196S/R306E | V196S/R332A | | | |

4. Exemplary Modified FX Polypeptides

Provided herein are modified FX polypeptides containing an amino acid replacement(s) in a precursor FX polypeptide set forth in SEQ ID NO:2, or in a variant thereof that exhibits at least 75% sequence identity thereto. For example, the modified FX polypeptide contains an amino acid replacement(s) in a FX polypeptide that exhibits at least 80%, 85%, 86%, 87%, 88%, 89%, 90%, 91%, 92%, 93%, 94%, 95%, 96%, 97%, 98%, 99% or more sequence identity to SEQ ID NO:2. Exemplary of such modified FX polypeptides are FX polypeptides having the sequence of amino acids set forth in any of SEQ ID NOS: 4-133, or the sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to any of SEQ ID NOS: 4-133. In particular examples, modified FX polypeptides are FX polypeptides having the sequence of amino acids set forth in any of SEQ ID NOS: 5-25, 32, 37, 41, 42, 44, 45, 47-49, 51-58, 60-71, 73-77, 81-111 and 114-133 or the sequence of amino acids that exhibits at least 75%, 80%, 85%, 86%, 87%, 88%, 89%, 90%, 91%, 92%, 93%, 94%, 95%, 96%; 97%, 98%, 99% or more sequence identity to any of SEQ ID NOS: 5-25, 32, 37, 41, 42, 44, 45, 47-49, 51-58, 60-71, 73-77, 81-111 and 114-133.

Provided herein are modified FX polypeptides containing an amino acid replacement(s) in a precursor FX polypeptide containing a heterologous signal sequence. For example, the heterologous signal sequence is from thrombin (e.g. corresponding to amino acids 1-43 of SEQ ID NO:415). For example, provided herein are modified FX polypeptides containing an amino acid replacement(s) in the FX polypeptide set forth in SEQ ID NO:415, or in a variant thereof that exhibits at least 75% sequence identity thereto. For example, the modified FX polypeptide contains an amino acid replacement(s) in a FX polypeptide that exhibits at least 80%, 85%, 86%, 87%, 88%, 89%, 90%, 91%, 92%, 93%, 94%, 95%, 96%, 97%, 98%, 99% or more sequence identity to SEQ ID NO:415. Exemplary of such modified FX polypeptides are FX polypeptides having the sequence of amino acids set forth in any of SEQ ID NOS: 417-546, or the sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to any of SEQ ID NOS: 417-546. In particular examples, modified FX polypeptides are FX polypeptides having the sequence of amino acids set forth in any of SEQ ID NOS: 418-438, 445, 450, 454, 455, 457, 458, 460-462, 464-471, 473-484, 486-490, 494-524 and 527-546 or the sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to any of SEQ ID NOS: 418-438, 445, 450, 454, 455, 457, 458, 460-462, 464-471, 473-484, 486-490, 494-524 and 527-546.

Provided herein are modified FX polypeptides containing an amino acid replacement(s) in a mature FX polypeptide set forth in SEQ ID NO:134, or in a variant thereof that exhibits at least 75% sequence identity thereto. For example, the modified FX polypeptide contains an amino acid replacement(s) in a FX polypeptide that exhibits at least 80%, 85%, 86%, 87%, 88%, 89%, 90%, 91%, 92%, 93%, 94%, 95%, 96%, 97%, 98%, 99% or more sequence identity to SEQ ID NO:134.

Exemplary of such modified FX polypeptides are FX polypeptides having the sequence of amino acids set forth in any of SEQ ID NOS: 136-265, or the sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to any of SEQ ID NOS: 136-265. In particular examples, modified FX polypeptides are FX polypeptides having the sequence of amino acids set forth in any of SEQ ID NOS: 137-157, 164, 169, 173, 174, 176, 177, 179-181, 183-190, 192-203, 205-209, 213-243 and 246-265 or the sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to any of SEQ ID NOS: 137-157, 164, 169, 173, 174, 176, 177, 179-181, 183-190, 192-203, 205-209, 213-243 and 246-265.

Also provided herein are zymogen, active or catalytically active forms of any of SEQ ID NOS:136-265, or of the sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to any of SEQ ID NOS: 136-265. In particular examples, are zymogen, active or catalytically active forms of any of SEQ ID NOS: 137-157, 164, 169, 173, 174, 176, 177, 179-181, 183-190, 192-203, 205-209, 213-243 and 246-265. Exemplary of such forms are two-chain forms having a heavy and light chain linked by a disulfide bond. The amino acid replacement(s) are in the heavy chain.

For example, provided herein are modified FX polypeptides that are zymogen forms of FX containing an amino acid replacement(s) in a zymogen FX polypeptide containing a light chain having the sequence of amino acids 1-139 of SEQ ID NO:134 and a heavy chain having the sequence of amino acids 143-448 of SEQ ID NO:134, or in a variant thereof that contains a heavy chain that exhibits at least 75% sequence identity to the light chain or heavy chain. For example, the modified FX polypeptide is a modified FX zymogen that contains an amino acid replacement(s) in a zymogen FX polypeptide that contains a light chain that exhibits at least 80%, 85%, 86%, 87%, 88%, 89%, 90%, 91%, 92%, 93%, 94%, 95%, 96%, 97%, 98%, 99% or more sequence identity to a zymogen FX light chain polypeptide having the sequence of amino acids 1-139 of SEQ ID NO:134 and/or a heavy chain that exhibits at least 80%, 85%, 86%, 87%, 88%, 89%, 90%, 91%, 92%, 93%, 94%, 95%, 96%, 97%, 98%, 99% or more sequence identity to a zymogen FX heavy chain polypeptide having the sequence of amino acids 143-448 of SEQ ID NO:134. Exemplary of such modified FX zymogen polypeptides are FX polypeptides containing a light chain having the sequence of amino acids 1-139 set forth in SEQ ID NO:134 (i.e. corresponding to amino acids 1-139 of any of SEQ ID NOS: 136-265) or a light chain having a sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to amino acids 1-139 set forth in any of SEQ ID NOS: 134; and a heavy chain having the sequence of amino acids 143-448 of any of SEQ ID NOS: 136-265, or a polypeptide containing a heavy chain having the sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to amino acids 143-448 set forth in any of SEQ ID NOS: 136-265. In particular examples modified FX zymogen polypeptides are FX polypeptides containing a light chain having the sequence of amino acids 1-139 set forth in SEQ ID NO:134 (i.e. corresponding to amino acids 1-139 of any of SEQ ID NOS: 136-265) or a light chain having a sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to amino acids 1-139 set forth in any of SEQ ID NOS: 134; and a heavy chain having the sequence of amino acids 143-448 of any of SEQ ID NOS: 137-157, 164, 169, 173, 174, 176, 177, 179-181, 183-190, 192-203, 205-209, 213-243 and 246-265, or a polypeptide containing a heavy chain having the sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to amino acids 143-448 set forth in any of SEQ ID NOS: 137-157, 164, 169, 173, 174, 176, 177, 179-181, 183-190, 192-203, 205-209, 213-243 and 246-265.

Provided herein are modified FX polypeptides that are FXa forms containing an amino acid replacement(s) in a FXa polypeptide containing a light chain having the sequence of amino acids 1-139 of SEQ ID NO:134 and a heavy chain having the sequence of amino acids 195-448 of SEQ ID NO:134, or in a variant thereof that exhibits at least 75% sequence identity to the light chain or heavy chain. For example, the modified FX polypeptide is a modified FXa that contains an amino acid replacement(s) in an FXa polypeptide that contains a light chain that exhibits at least 80%, 85%, 86%, 87%, 88%, 89%, 90%, 91%, 92%, 93%, 94%, 95%, 96%, 97%, 98%, 99% or more sequence identity to a FXa light chain polypeptide having the sequence of amino acids 1-139 of SEQ ID NO:134 and/or a heavy chain that exhibits at least 80%, 85%, 86%, 87%, 88%, 89%, 90%, 91%, 92%, 93%, 94%, 95%, 96%, 97%, 98%, 99% or more sequence identity to a FXa heavy chain polypeptide having the sequence of amino acids 195-448 of SEQ ID NO:134. Exemplary of such modified FXa polypeptides are FX polypeptides containing a light chain having the sequence of amino acids 1-139 set forth in SEQ ID NO:134 (i.e. corresponding to amino acids 1-139 of any of SEQ ID NOS: 136-265), or a light chain having a sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to amino acids 1-139 set forth in any of SEQ ID NOS: 134; and a heavy chain having the sequence of amino acids 195-448 of any of SEQ ID NOS: 136-265, or a polypeptide containing a heavy chain having the sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to amino acids 195-448 set forth in any of SEQ ID NOS: 136-265. In particular examples, modified FXa polypeptides are FX polypeptides containing a light chain having the sequence of amino acids 1-139 set forth in SEQ ID NO:134 (i.e. corresponding to amino acids 1-139 of any of SEQ ID NOS: 136-265), or a light chain having a sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to amino acids 1-139 set forth in any of SEQ ID NOS: 134; and a heavy chain having the sequence of amino acids 195-448 of any of SEQ ID NOS: 137-157, 164, 169, 173, 174, 176, 177, 179-181, 183-190, 192-203, 205-209, 213-243 and 246-265, or a polypeptide containing a heavy chain having the sequence of amino acids that exhibits at least 75%, 80%, 85%, 86%, 87%, 88%, 89%, 90%, 91%, 92%, 93%, 94%, 95%, 96%, 97%, 98%, 99% or more sequence identity to amino acids 195-448 set forth in any of SEQ ID NOS: 137-157, 164, 169, 173, 174, 176, 177, 179-181, 183-190, 192-203, 205-209, 213-243 and 246-265.

Table 14 summarizes exemplary modified FX polypeptides provided herein.

TABLE 14

| Peptide | FX Prepropeptide SEQ ID NO. | Thrombin-FX hybrid SEQ ID NO. | Mature FX SEQ ID NO. | FX Zymogen LC: aa 1-139; HC: aa 143-448 of SEQ ID NO. | Activated FX (FXa) LC: aa 1-139; HC: aa 195-448 of SEQ ID NO. |
|---|---|---|---|---|---|
| V196I | 4 | 417 | 136 | 136 | 136 |
| V196S | 5 | 418 | 137 | 137 | 137 |
| T85N/K87S/V196S | 6 | 419 | 138 | 138 | 138 |
| Q56N/Q58S/V196S | 7 | 420 | 139 | 139 | 139 |
| K62N/G64S/V196S | 8 | 421 | 140 | 140 | 140 |
| L65N/E67S/V196S | 9 | 422 | 141 | 141 | 141 |
| E67N/V196S | 10 | 423 | 142 | 142 | 142 |
| L73N/G75S/V196S | 11 | 424 | 143 | 143 | 143 |
| G75N/E77S/V196S | 12 | 425 | 144 | 144 | 144 |
| R86N/L88S/V196S | 13 | 426 | 145 | 145 | 145 |
| G114N/V196S | 14 | 427 | 146 | 146 | 146 |
| D95N/D97S/V196S | 15 | 428 | 147 | 147 | 147 |
| E82S/V196S | 16 | 429 | 148 | 148 | 148 |
| E82N/F84S/V196S | 17 | 430 | 149 | 149 | 149 |
| G78N/N80S/V196S | 18 | 431 | 150 | 150 | 150 |
| E77N/K79S/V196S | 19 | 432 | 151 | 151 | 151 |
| D119N/G121S/V196S | 20 | 433 | 152 | 152 | 152 |
| L83N/V196S | 21 | 434 | 153 | 153 | 153 |
| K122S/V196S | 22 | 435 | 154 | 154 | 154 |
| E51N/V196S | 23 | 436 | 155 | 155 | 155 |
| Q58N/K60S/V196S | 24 | 437 | 156 | 156 | 156 |
| G114N/D119N/G121S/V196S | 25 | 438 | 157 | 157 | 157 |
| G198A | 26 | 439 | 158 | 158 | 158 |
| G198V | 27 | 440 | 159 | 159 | 159 |
| G198R | 28 | 441 | 160 | 160 | 160 |
| G198K | 29 | 442 | 161 | 161 | 161 |
| G198P | 30 | 443 | 162 | 162 | 162 |
| G198H | 31 | 444 | 163 | 163 | 163 |
| L211S/G219H | 32 | 445 | 164 | 164 | 164 |
| G197P | 33 | 446 | 165 | 165 | 165 |
| D378N | 34 | 447 | 166 | 166 | 166 |
| D378S | 35 | 448 | 167 | 167 | 167 |
| V196L | 36 | 449 | 168 | 168 | 168 |
| V196T | 37 | 450 | 169 | 169 | 169 |
| V196P | 38 | 451 | 170 | 170 | 170 |
| G197V | 39 | 452 | 171 | 171 | 171 |
| G197T | 40 | 453 | 172 | 172 | 172 |
| G197S | 41 | 454 | 173 | 173 | 173 |
| E200A | 42 | 455 | 174 | 174 | 174 |
| E200S | 43 | 456 | 175 | 175 | 175 |
| E200V | 44 | 457 | 176 | 176 | 176 |
| K202S | 45 | 458 | 177 | 177 | 177 |
| R326A | 46 | 459 | 178 | 178 | 178 |
| R326S | 47 | 460 | 179 | 179 | 179 |
| R326T | 48 | 461 | 180 | 180 | 180 |
| R326V | 49 | 462 | 181 | 181 | 181 |
| R326Q | 50 | 463 | 182 | 182 | 182 |
| R326N | 51 | 464 | 183 | 183 | 183 |
| R326M | 52 | 465 | 184 | 184 | 184 |

TABLE 14-continued

| Peptide | FX Prepropeptide SEQ ID NO. | Thrombin-FX hybrid SEQ ID NO. | Mature FX SEQ ID NO. | FX Zymogen LC: aa 1-139; HC: aa 143-448 of SEQ ID NO. | Activated FX (FXa) LC: aa 1-139; HC: aa 195-448 of SEQ ID NO. |
|---|---|---|---|---|---|
| R326K | 53 | 466 | 185 | 185 | 185 |
| R326Y | 54 | 467 | 186 | 186 | 186 |
| T327A | 55 | 468 | 187 | 187 | 187 |
| T327L | 56 | 469 | 188 | 188 | 188 |
| S334A | 57 | 470 | 189 | 189 | 189 |
| S334T | 58 | 471 | 190 | 190 | 190 |
| S334N | 59 | 472 | 191 | 191 | 191 |
| R336E | 60 | 473 | 192 | 192 | 192 |
| K338A | 61 | 474 | 193 | 193 | 193 |
| K338S | 62 | 475 | 194 | 194 | 194 |
| K338N | 63 | 476 | 195 | 195 | 195 |
| K338R | 64 | 477 | 196 | 196 | 196 |
| K338V | 65 | 478 | 197 | 197 | 197 |
| K338Y | 66 | 479 | 198 | 198 | 198 |
| K338M | 67 | 480 | 199 | 199 | 199 |
| T327A/K338A | 68 | 481 | 200 | 200 | 200 |
| T327L/K338M | 69 | 482 | 201 | 201 | 201 |
| E200V/T327L/K338M | 70 | 483 | 202 | 202 | 202 |
| E200V/T327L/S334A/K338M | 71 | 484 | 203 | 203 | 203 |
| V196S/G197A | 72 | 485 | 204 | 204 | 204 |
| V196S/L211S/G219H | 73 | 486 | 205 | 205 | 205 |
| D119N/G121S/V196S/L211S/G219H | 74 | 487 | 206 | 206 | 206 |
| G114N/V196S/L211S/G219H | 75 | 488 | 207 | 207 | 207 |
| G114N/D119N/G121S/V196S/L211S/G219H | 76 | 489 | 208 | 208 | 208 |
| G197A/L211S/G219H | 77 | 490 | 209 | 209 | 209 |
| V196S/G197A/L211S/G219H | 78 | 491 | 210 | 210 | 210 |
| I195L/V196S | 79 | 492 | 211 | 211 | 211 |
| I195L/G197A | 80 | 493 | 212 | 212 | 212 |
| I195L/L211S/G219H | 81 | 494 | 213 | 213 | 213 |
| V196S/N214D | 82 | 495 | 214 | 214 | 214 |
| V196S/N214A | 83 | 496 | 215 | 215 | 215 |
| V196S/N214S | 84 | 497 | 216 | 216 | 216 |
| V196S/E216R | 85 | 498 | 217 | 217 | 217 |
| V196S/E216K | 86 | 499 | 218 | 218 | 218 |
| V196S/E216A | 87 | 500 | 219 | 219 | 219 |
| V196S/E216S | 88 | 501 | 220 | 220 | 220 |
| V196S/E218R | 89 | 502 | 221 | 221 | 221 |
| V196S/E218K | 90 | 503 | 222 | 222 | 222 |
| V196S/E218A | 91 | 504 | 223 | 223 | 223 |
| V196S/R332A | 92 | 505 | 224 | 224 | 224 |
| V196S/R332D | 93 | 506 | 225 | 225 | 225 |
| V196S/R332E | 94 | 507 | 226 | 226 | 226 |
| V196S/R332S | 95 | 508 | 227 | 227 | 227 |
| V196S/R332G | 96 | 509 | 228 | 228 | 228 |
| V196S/R326E | 97 | 510 | 229 | 229 | 229 |
| V196S/R326D | 98 | 511 | 230 | 230 | 230 |
| V196S/R326M | 99 | 512 | 231 | 231 | 231 |
| V196S/R326N | 100 | 513 | 232 | 232 | 232 |
| V196S/R326Q | 101 | 514 | 233 | 233 | 233 |
| V196S/R273E | 102 | 515 | 234 | 234 | 234 |
| V196S/R273A | 103 | 516 | 235 | 235 | 235 |
| V196S/R424A | 104 | 517 | 236 | 236 | 236 |
| V196S/R424E | 105 | 518 | 237 | 237 | 237 |
| V196S/K420A | 106 | 519 | 238 | 238 | 238 |
| V196S/K420E | 107 | 520 | 239 | 239 | 239 |
| V196S/R306E | 108 | 521 | 240 | 240 | 240 |
| V196S/K276A | 109 | 522 | 241 | 241 | 241 |
| V196S/K276E | 110 | 523 | 242 | 242 | 242 |
| V196S/K420E/R424E | 111 | 524 | 243 | 243 | 243 |
| V196S/R273E/K420E/R424E | 112 | 525 | 244 | 244 | 244 |
| V196S/R273E/R306E/K420E/R424E | 113 | 526 | 245 | 245 | 245 |
| V196S/K338A | 114 | 527 | 246 | 246 | 246 |
| V196S/K338S | 115 | 528 | 247 | 247 | 247 |
| V196S/E215N/N217S | 116 | 529 | 248 | 248 | 248 |
| V196S/E264N/E266S | 117 | 530 | 249 | 249 | 249 |
| D119N/G121S/V196S/E264N/E266S | 118 | 531 | 250 | 250 | 250 |

TABLE 14-continued

| Peptide | FX Prepropeptide SEQ ID NO. | Thrombin-FX hybrid SEQ ID NO. | Mature FX SEQ ID NO. | FX Zymogen LC: aa 1-139; HC: aa 143-448 of SEQ ID NO. | Activated FX (FXa) LC: aa 1-139; HC: aa 195-448 of SEQ ID NO. |
|---|---|---|---|---|---|
| G114N/V196S/E264N/E266S | 119 | 532 | 251 | 251 | 251 |
| V196S/R429N/L431S | 120 | 533 | 252 | 252 | 252 |
| V196S/R243N/K245S | 121 | 534 | 253 | 253 | 253 |
| V196S/T293N/R295S | 122 | 535 | 254 | 254 | 254 |
| V196S/D389N/Y391S | 123 | 536 | 255 | 255 | 255 |
| V196S/K388N | 124 | 537 | 256 | 256 | 256 |
| D119N/G121S/V196S/K388N | 125 | 538 | 257 | 257 | 257 |
| V196S/T428N/G430S | 126 | 539 | 258 | 258 | 258 |
| V196S/L211S/G219H/E264N/E266S | 127 | 540 | 259 | 259 | 259 |
| D119N/G121S/V196S/L211S/G219H/E264N/E266S | 128 | 541 | 260 | 260 | 260 |
| G114N/V196S/L211S/G219H/E264N/E266S | 129 | 542 | 261 | 261 | 261 |
| V196S/E264N/E266S/K388N | 130 | 543 | 262 | 262 | 262 |
| D119N/G121S/V196S/L211S/G219H/K388N | 131 | 544 | 263 | 263 | 263 |
| G114N/V196S/L211S/G219H/K388N | 132 | 545 | 264 | 264 | 264 |
| V196S/L211S/G219H/E264N/E266S/K388N | 133 | 546 | 265 | 265 | 265 |

5. Additional Modifications

Additional modifications can be made to any of the modified FX polypeptides provided herein. The additional modification(s) can be amino acid insertions, deletions, replacements, chemical modifications and/or post-translational modifications. For example, further amino acid replacement(s) can be made in a modified FX polypeptide in order to provide an attachment site for a chemical moiety (e.g. a polymer moiety), to introduce one or more further non-native glycosylation sites, and/or to improve or alter the activity or other properties of the polypeptide. Exemplary of properties or activities that can be altered include, but are not limited to, solubility, stability, catalytic activity (e.g. prothrombinase activity), binding to cofactors (e.g. FVa), substrate specificity, substrate selectivity, and/or binding to inhibitors (e.g. ATIII).

Such modification(s) are well known to one of skill in the art (see e.g. U.S. Patent Nos. 5,990,079; 6,017,882; 6,573,071 6,573071; 6,562,598; 6,660,492; 6,670,147; 6,958,322, 7,078,508; 7,220,569; 7,645,602; 8,048,990; U.S. Published Application Nos.: US20030207402; US2006-0148038; US20090053185; US20090175828; US20090175931; US20100125052; US20100255000; US2010-0285568; 2011-0015128; 2011-0293597; International Published PCT Application Nos: WO1998039456 and WO2005023308; and Uprichard and Perry, Blood Rev 16: 97-110 (2002); Venkateswarlu et al.,*Biophys J*82(3):1190-1206 (2002); Vianello et al., Thromb. Res. 107:51-54 (2002); Vianello et al. *Thromb. Res.* 104:257-264(2001); Vianello et al., Blood Coagul. Fibrinolysis 14:401-405 (2003); Wallmark et al., Blood 78(supple1): 60 (1991); Wallmark et al., *Thromb Haemost.* 65:1263 (1991); Wang et al., Haemophilia. 11(1):31-37 (2005); Wang et al., Haematologica. 90(12):1659-1664 (2005); Watzke et al., *J. Biol. Chem.* 265:11982-11989 (1990); Watzke et al., *J Clin Invest.* 88(5):1685-1689 (1991); Watzke et al., Thromb Haemost 69:1452 (1993); Whinna et al., *J. Thromb Haemost* 2(7):1127-1134; Yang et al., *Biochemistry* 47(22):5976-5985 (2008); and Zama et al., *Br. J. Haematol.* 106:809-811 (1999), For example, a modified FX polypeptide can be modified to render the polypeptide susceptible to conjugation with a polymer. Exemplary polymers include, for example, copolymers of polyethylene glycol and polypropylene glycol, carboxymethylcellulose, dextran, polyvinyl alcohol, polyvinylpyrrolidine or polyproline (Abuchowski et al. (1981); Newmark et al. (1982); and Katre et al. (1987)). A modified FX polypeptide provided herein can be modified with one or more polyethylene glycol moieties (PEGylated). Activated PEG derivatives can be used to interact directly with the FX polypeptides, and include active esters of carboxylic acid or carbonate derivatives, particularly those in which the leaving groups are N-hydroxysuccinimide, p-nitrophenol, imidazole or 1-hydroxy-2-nitrobenzene-4-sulfonate. PEG derivatives containing maleimido or haloacetyl groups can be used for the modification of sulthydryl groups, and PEG reagents containing hydrazine or hydrazide groups can be used to modify aldehydes generated by periodate oxidation of carbohydrate groups.

Also contemplated are modified FX polypeptides sequences that have phosphorylated amino acid residues, such as phosphotyrosine, phosphoserine or phosphothreonine. Additional modifications of polypeptides provided herein include chemical derivatization of polypeptides, including but not limited to, acetylation and carboxylation. For example acylated inactive variants of FX have been produced, which are slowly deacylated after injection into blood plasma thereby generating activated factor X over time (Wolf et al. (1995) Blood. 86, pp 4153-4157).

Other suitable additional modifications of a modified FX polypeptide provided herein are polypeptides that have been modified using standard chemical techniques and/or recombinant nucleic acid method as to increase their resistance to proteolytic degradation, to optimize solubility properties and/or to render them more suitable as a therapeutic agent. For example, the backbone of the peptide can be cyclized to enhance stability (see such as, Friedler et al. (2000) *J. Biol. Chem.* 275:23783-23789). Analogs can be used that include residues other than naturally occurring L-amino acids, such as, D-amino acids or non-naturally occurring synthetic amino acids.

Additional modifications include modifications that alter, increase or improve the cellular processing and/or post-translational modifications of the polypeptide. For example, additional modifications include those in the region of the propeptide cleavage site (e.g. Thr39) in order to improve the efficacy of propeptide processing in cell culture (Rudolph et al. (1997) *Prot. Express and Puri.*, 10: 373-378). In other examples, and as described elsewhere herein, a higher degree of gamma carboxylation can be achieved by replacing the prepropeptide of factor X by that of thrombin (see e.g. Camire et al. (2000) *Biochemistry.* 39 pp. 14322-14329).

Other exemplary additional modifications include amino acid replacement(s) to alter one or more properties or activities of the polypeptides. For example, modifications include those that alter the dependence for Vitamin K, which is required for its synthesis, for example by modification of residues in the Gla domain including but not limited to amino acid replacement at positions 10, 11, 12, 28, 29, 32, 33, 34 or 35 corresponding to residues set forth in SEQ ID NO:134 (see e.g. U.S. Pat. Nos. 6,017,882 and 8,048,990). Modifications also can be made enhance the ability of FX to be activated, such as by amino acid replacement(s) of residues in the activation peptide with heterologous residues of another serine protease or other peptide or protein (see e.g. U.S. Pat. Nos. 6,958,322 and 6,573,071; International PCT published application Nos. WO 98/38317, WO 03/035861, WO 2004/005347; U.S. Published Application No. 2006/0148038; Himmelspach et al. Thromb. Res., 97, 51-67 (2000); Wolf et al. (1991) *JBC.* 266, no. 21. pp. 13726-13730; Volkel et al (2005), *Mol. Biotechnol.*, 29 (1):19-30. Additional modifications include modifications to delete the activation peptide such that the FX polypeptide is auto-activated in a cofactor independent way (Rudolph et al., (2002) *Thromb Haemost.*, 88:756-62). Further modifications include modifications that alter or modify the activation cleavage site so that other proteases that do not naturally activate FX can cleave and activate FX (see e.g. WO 98/38317; WO 98/38318; WO 01/10896).

Chimeric proteins of a modified FX provided herein can be made. For example, a portion of the light chain (e.g. Gla domain and/or EGF domain(s)) can be replaced with the corresponding portion from another coagulation protease, such as FIX, in order to generate chimeras that interact productively with coagulation factor complexes in the pathway, such as TF/FVIIa complex (Thiec et al. (2003) *JBC*, 12: 10393-10399)

E. Production of FX Polypeptides

FX polypeptides, including modified FX polypeptides, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a FX polypeptide, such as from a cell or tissue source, such as for example from liver. cDNA also can be obtained commercially (e.g. Origene, Rockville, Md.) or via synthetic methods. Modified FX polypeptides can be engineered as described herein, such as by site-directed mutagenesis.

FX can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a FX polypeptide, including for example, polymerase chain reaction (PCR) methods. A nucleic acid containing material can be used as a starting material from which a FX-encoding nucleic acid molecule can be isolated. For example, DNA and mRNA preparations, cell extracts, tissue extracts (e.g. from liver), fluid samples (e.g. blood, serum, saliva), samples from healthy and/or diseased subjects can be used in amplification methods. Nucleic acid libraries also can be used as a source of starting material. Primers can be designed to amplify a FX-encoding molecule. For example, primers can be designed based on expressed sequences from which a FX is generated. Primers can be designed based on back-translation of a FX amino acid sequence. Nucleic acid molecules generated by amplification can be sequenced and confirmed to encode a FX polypeptide.

Additional nucleotide sequences can be joined to a FX-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a FX-encoding nucleic acid molecule. Examples of such sequences include, but are not limited to, promoter sequences designed to facilitate intracellular protein expression, and secretion sequences designed to facilitate protein secretion. Additional nucleotide sequences such as sequences specifying protein binding regions also can be linked to FX-encoding nucleic acid molecules. Such regions include, but are not limited to, sequences to facilitate uptake of FX into specific target cells, or otherwise enhance the pharmacokinetics of the synthetic gene.

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pBR322 or pUC plasmid derivatives or the Bluescript vector (Stratagene, La Jolla, Calif.). The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and FX protein gene can be modified by homopolymeric tailing. Recombinant molecules can be introduced into host cells via, for example, transformation, transfection, infection, electroporation and sonoporation, so that many copies of the gene sequence are generated.

Any method known in the art to effect mutation of any one or more amino acids in a target protein can be employed. Methods include standard site-directed or random mutagenesis of encoding nucleic acid molecules, or solid phase polypeptide synthesis methods. For example, nucleic acid molecules encoding a FX polypeptide can be subjected to mutagenesis, such as random mutagenesis of the encoding nucleic acid, error-prone PCR, site-directed mutagenesis (using e.g., a kit, such as kit such as QuikChange available from Stratagene), overlap PCR, gene shuffling, or other recombinant methods. The nucleic acid encoding the polypeptides can then be introduced into a host cell to be expressed heterologously. In some examples, the modified FX polypeptides are produced synthetically, such as using solid phase or solutions phase peptide synthesis.

In specific embodiments, transformation of host cells with recombinant DNA molecules that incorporate the isolated FX protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the FX proteins, the nucleic acid containing all or a portion of the nucleotide sequence encoding the FX protein can be inserted into an appropriate expression vector, i.e., a vector that contains the necessary elements for the transcription and translation of the inserted protein coding sequence. Exemplary of such a vector is any mammalian expression vector such as, for example, pCMV. The necessary transcriptional and translational signals also can be supplied by the native promoter for a FX genes, and/or their flanking regions.

Also provided are vectors that contain nucleic acid encoding the FX or modified FX. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a FX polypeptide or modified FX polypeptide thereof by growing the above-described cells under conditions whereby the encoded FX protein is expressed by the cell, and recovering the expressed FX protein. For purposes herein, the FX can be secreted into the medium.

In one embodiment, vectors containing a sequence of nucleotides that encodes a polypeptide that has FX activity and contains all or a portion of the FX polypeptide, or multiple copies thereof, are provided. The vectors can be selected for expression of the FX polypeptide or modified FX polypeptide thereof in the cell or such that the FX protein is expressed as a secreted protein. When the FX is expressed the nucleic acid is linked to nucleic acid encoding a secretion signal, such as the *Saccharomyces cerevisiae* α-mating factor signal sequence or a portion thereof, or the native signal sequence.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding a FX polypeptide or modified FX polypeptide, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a FX protein. Promoters which can be used include but are not limited to the SV40 early promoter (Bernoist and Chambon, Nature 290:304-310 (1981)), the promoter contained in the 3' long terminal repeat of Rous sarcoma virus (Yamamoto et al. Cell 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., Nature 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242:79-94 (1980)); plant expression vectors containing the nopaline synthetase promoter (Herrara-Estrella et al., *Nature* 303:209-213 (1984)) or the cauliflower mosaic virus 35S RNA promoter (Garder et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Ga14 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., Cell 38:639-646 (1984); Ornitz et al., Cold Spring Harbor Symp. Quant. Biol. 50:399-409 (1986); MacDonald, Hepatology 7:42S-52S (1987)); insulin gene control region which is active in pancreatic beta cells (Hanahan et al., *Nature* 315:115-122(1985)), immunoglobulin gene control region which is active in lymphoid cells (Grosschedl et al., Cell 38:647-658 (1984); Adams et al., *Nature* 318:533-538 (1985); Alexander et aL, *Mol. Cell Biol.* 7:1436-1444 (1987)), mouse mammary tumor virus control region which is active in testicular, breast, lymphoid and mast cells (Leder et al., Cell 45:485-495 (1986)), albumin gene control region which is active in liver (Pinckert et al., Genes and Devel. 1:268-276 (1987)), alpha-fetoprotein gene control region which is active in liver (Krumlauf et al., *Mol. Cell. Biol.* 5:1639-1648 (1985); Hammer et al., Science 235:53-58 1987)), alpha-1 antitrypsin gene control region which is active in liver (Kelsey et al., Genes and Devel. 1:161-171 (1987)), beta globin gene control region which is active in myeloid cells (Magram et al., *Nature* 315:338-340(1985); Kollias et al., Cell 46:89-94 (1986)), myelin basic protein gene control region which is active in oligodendrocyte cells of the brain (Readhead et al., Cell 48:703-712 (1987)), myosin light chain-2 gene control region which is active in skeletal muscle (Shani, *Nature* 314:283-286(1985)), and gonadotrophic releasing hormone gene control region which is active in gonadotrophs of the hypothalamus (Mason et al., Science 234:1372-1378 (1986)).

In a specific embodiment, a vector is used that contains a promoter operably linked to nucleic acids encoding a FX polypeptide or modified FX polypeptide, or a domain, fragment, derivative or homolog, thereof, one or more origins of replication, and optionally, one or more selectable markers (e.g., an antibiotic resistance gene). Vectors and systems for expression of FX polypeptides include the well known *Pichia* vectors (available, for example, from Invitrogen, San Diego, Calif.), particularly those designed for secretion of the encoded proteins. Exemplary plasmid vectors for expression in mammalian cells include, for example, pCMV, pFUSE (InvivoGen) and many other vectors well known to one of skill in the art. Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from NOVAGEN, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (NOVAGEN, Madison, Wis.), which contain a His-Tag™ leader sequence for use in purification with a H is column and a thrombin cleavage site that permits cleavage following purification over the column, the T7-lac promoter region and the T7 terminator.

2. Expression Systems

FX polypeptides (modified and unmodified) can be produced by any methods known in the art for protein production including in vitro and in vivo methods such as, for example, the introduction of nucleic acid molecules encoding FX into a host cell, host animal and expression from nucleic acid molecules encoding FX in vitro. FX and modified FX polypeptides can be expressed in any organism suitable to produce the required amounts and forms of a FX polypeptide needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Expression in eukaryotic hosts can include expression in yeasts such as *Saccharomyces cerevisiae* and *Pichia* pastoria, insect cells such as *Drosophila* cells and *lepidopteran* cells, plants and plant cells such as tobacco, corn, rice, algae, and lemna. Eukaryotic cells for expression also include mammalian cells lines such as Chinese hamster ovary (CHO) cells or baby hamster kidney (BHK) cells. Eukaryotic expression hosts also include production in transgenic animals, for example, including production in serum, milk and eggs.

Many expression vectors are available and known to those of skill in the art for the expression of FX. The choice of expression vector is influenced by the choice of host expression system. Such selection is well within the level of skill of the skilled artisan. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vectors in the cells.

FX or modified FX polypeptides also can be utilized or expressed as protein fusions. For example, a fusion can be generated to add additional functionality to a polypeptide. Examples of fusion proteins include, but are not limited to, fusions of a signal sequence, a tag such as for localization, e.g. a $his_6$ tag or a myc tag, or a tag for purification, for example, a GST fusion, and a sequence for directing protein secretion and/or membrane association.

In one embodiment, the protease is expressed in an inactive, zymogen form. In another embodiment, the FX polypeptide or modified FX polypeptides can be generated to be in an active form, whereby activation is achieved by reaction with Russell's Viper Venom FX Activator (Haematologic Technologies) following expression secretion and purification of the FX zymogen form of the polypeptide. In such an example, the activator can be removed from the resulting purified preparation by dialysis or by using an affinity column compatible with the activator (e.g. biotin-streptavidin).

In some instances, the unactivated FX polypeptide form is removed from the activated FXa form in the preparation. For example, since FXa is conformationally altered, it exhibits the ability to bind to heparin. Thus, FXa can be purified from preparations also containing a zymogen form by chromatography using a Heparin column. This is exemplified in Example 2 herein. Generally, in examples here, the FXa polypeptide exhibits a purity of at least 70%, and generally at least 75%, 80%, 85%, 86%, 87%, 88%, 89%, 90%, 91%, 92%, 93%, 94%, 95%, 96%, 97%, 98%, 99% or greater. Generally the FXa preparations are substantially free from other protein contaminants, including FX zymogen forms.

a. Prokaryotic Expression

Prokaryotes, especially *E. coli*, provide a system for producing large amounts of FX (see, for example, Platis et al. (2003) Protein Exp. Purif. 31(2): 222-30; and Khalilzadeh et al. (2004) J. Ind. Microbiol. Biotechnol. 31(2): 63-69). Transformation of *E. coli* is a simple and rapid technique well known to those of skill in the art. Expression vectors for *E. coli* can contain inducible promoters that are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated $\lambda P_L$ promoter.

FX can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants (e.g., such as guanidine-HCl and urea) can be used to resolubilize the proteins. An alternative approach is the expression of FX in the periplasmic space of bacteria which provides an oxidizing environment and chaperonin-like and disulfide isomerases leading to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility. Typically, temperatures between 25° C. and 37° C. are used. Mutations also can be used to increase solubility of expressed proteins. Typically, bacteria produce aglycosylated proteins. Thus, if proteins require glycosylation for function, glycosylation can be added in vitro after purification from host cells.

b. Yeast

Yeasts such as *Saccharomyces cerevisiae, Schizosaccharomyces pombe, Yarrowia lipolytica, Kluyveromyces lactis*, and *Pichia pastoris* are useful expression hosts for FX (see for example, Skoko et al. (2003) Biotechnol. Appl. Biochem. 38(Pt3):257-65). Yeast can be transformed with episomal replicating vectors or by stable chromosomal integration by homologous recombination. Typically, inducible promoters are used to regulate gene expression. Examples of such promoters include GAL1, GAL7, and GAL5 and metallothionein promoters such as CUP1. Expression vectors often include a selectable marker such as LEU2, TRP1, HIS3, and URA3 for selection and maintenance of the transformed DNA. Proteins expressed in yeast are often soluble and co-expression with chaperonins, such as Bip and protein disulfide isomerase, can improve expression levels and solubility. Additionally, proteins expressed in yeast can be directed for secretion using secretion signal peptide fusions such as the yeast mating type alpha-factor secretion signal from *Saccharomyces cerevisiae* and fusions with yeast cell surface proteins such as the Aga2p mating adhesion receptor or the *Arxula adeninivorans* glucoamylase. A protease cleavage site (e.g., the Kex-2 protease) can be engineered to remove the fused sequences from the polypeptides as they exit the secretion pathway. Yeast also is capable of glycosylation at Asn-X-Ser/Thr motifs.

c. Insects and Insect Cells

Insects and insect cells, particularly using a baculovirus expression system, are useful for expressing polypeptides such as FX or modified forms thereof (see, for example, Muneta et al. (2003) J. Vet. Med. Sci. 65(2):219-23). Insect cells and insect larvae, including expression in the haemolymph, express high levels of protein and are capable of most of the post-translational modifications used by higher eukaryotes. Baculoviruses have a restrictive host range which improves the safety and reduces regulatory concerns of eukaryotic expression. Typically, expression vectors use a promoter such as the polyhedrin promoter of baculovirus for high level expression. Commonly used baculovirus systems include baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express FX polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high level expression, for example the SV40 promoter-enhancer, the human cytomegalovirus (CMV) promoter, and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha-fetoprotein, alpha 1-antitrypsin, beta-globin, myelin basic protein, myosin light chain-2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Fusion with cell surface signaling molecules such as TCR-$\xi$ and Fc$_\epsilon$RI-$\gamma$ can direct expression of the proteins in an active state on the cell surface.

Many cell lines are available for mammalian expression including mouse, rat human, monkey, and chicken and hamster cells. Exemplary cell lines include, but are not limited to, BHK (i.e. BHK-21 cells), 293-F, CHO, Balb/3T3, HeLa, MT2, mouse NS0 (non-secreting) and other myeloma cell lines, hybridoma and heterohybridoma cell lines, lymphocytes, fibroblasts, Sp2/0, COS, NIH3T3, HEK293, 293S, 293T, 2B8, and HKB cells. Cell lines also are available adapted to serum-free media which facilitates purification of secreted proteins from the cell culture media. One such example is the serum free EBNA-1 cell line (Pham et al., (2003) *Biotechnol. Bioeng.* 84:332-42).

e. Plants

Transgenic plant cells and plants can be used for the expression of FX. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements, and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Because plants have different glycosylation patterns than mammalian cells, this can influence the choice to produce FX in these hosts. Transgenic plant cells also can include algae engineered to produce proteins (see, for example, Mayfield et al. (2003) PNAS 100:438-442). Because plants have different glycosylation patterns than mammalian cells, this can influence the choice to produce FX in these hosts.

2. Purification

Methods for purification of FX polypeptides from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary further the proteins can be extracted and further purified using standard methods in the art.

FX can be purified using standard protein purification techniques known in the art including but not limited to, SDS-PAGE, size fraction and size exclusion chromatography, ammonium sulfate precipitation, chelate chromatography and ionic exchange chromatography. For example, FX polypeptides can be purified by anion exchange chromatography. Exemplary of a method to purify FX polypeptides is by using an ion exchange column that permits binding of any polypeptide that has a functional Gla domain, followed by elution in the presence of calcium. Affinity purification techniques also can be used to improve the efficiency and purity of the preparations. For example, antibodies, receptors and other molecules that bind FX can be used in affinity purification. Expression constructs also can be engineered to add an affinity tag such as a myc epitope, GST fusion or $His_6$ and affinity purified with myc antibody, glutathione resin, and Ni-resin, respectively, to a protein. Purity can be assessed by any method known in the art including gel electrophoresis and staining and spectrophotometric techniques.

As discussed above, the FX protease can be expressed and purified to be in an inactive form (zymogen form) or alternatively the expressed protease can be purified into an active form. The FX zymogen polypeptides can be first prepared by any of the methods of production described herein, including, but not limited to, production in mammalian cells followed by purification. FXa polypeptides that have been activated via removal of the activation peptide can be prepared in vitro (i.e. FXa; two-chain form). Cleavage of the FX polypeptides into the active protease form, FXa, can be accomplished by reaction with an activator (e.g. Russell's Viper Venom FX Activator), removal of the activator and further removal of the inactive form.

3. Fusion Proteins

Fusion proteins containing a modified FX polypeptide and one or more other polypeptides also are provided. Pharmaceutical compositions containing such fusion proteins formulated for administration by a suitable route are provided. Fusion proteins are formed by linking in any order the modified FX polypeptide and an agent, such as an antibody or fragment thereof, growth factor, receptor, ligand, and other such agent for the purposes of facilitating the purification of a FX polypeptide, altering the pharmacodynamic properties of a FX polypeptide by directing, for example, by directing the polypeptide to a targeted cell or tissue, and/or increasing the expression or secretion of the FX polypeptide. Typically any FX fusion protein retains at least about 30%, 40%, 50%, 60%, 70%, 80%, 90%, or 95% catalytic activity compared with a non-fusion FX polypeptide, including 96%, 97%, 98%, 99% or greater catalytic activity compared with a non-fusion polypeptide.

Linkage of a FX polypeptide with another polypeptide can be effected directly or indirectly via a linker. In one example, linkage can be by chemical linkage, such as via heterobifunctional agents or thiol linkages or other such linkages. Fusion also can be effected by recombinant means. Fusion of a FX polypeptide to another polypeptide can be to the N- or C-terminus of the FX polypeptide. Non-limiting examples of polypeptides that can be used in fusion proteins with a FX polypeptide provided herein include, for example, a GST (glutathione S-transferase) polypeptide, Fc domain from immunoglobulin G, or a heterologous signal sequence (e.g. from thrombin). The fusion proteins can contain additional components, such as *E. coli* maltose binding protein (MBP) that aid in uptake of the protein by cells (see, International PCT application No. WO 01/32711).

A fusion protein can be produced by standard recombinant techniques. For example, DNA fragments coding for the different polypeptide sequences can be ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). A FX-encoding nucleic acid can be cloned into such an expression vector such that the fusion moiety is linked in-frame to the protease protein.

4. Polypeptide Modification

Modified FX polypeptides can be prepared as naked polypeptide chains or as a complex. For some applications, it can be desirable to prepare modified FX in a "naked" form without post-translational or other chemical modifications. Naked polypeptide chains can be prepared in suitable hosts that do not post-translationally modify FX. Such polypeptides also can be prepared in in vitro systems and using chemical polypeptide synthesis. For other applications, particular modifications can be desired including pegylation, albumination, glycosylation, carboxylation, hydroxylation, phosphorylation, or other known modifications. Modifications can be made in vitro or, for example, by producing the modified FX in a suitable host that produces such modifications.

5. Nucleotide Sequences

Nucleic acid molecules encoding FX or modified FX polypeptides are provided herein. Nucleic acid molecules include allelic variants or splice variants of any encoded FX polypeptide. Exemplary of nucleic acid molecules provided herein are any that encode a modified FX polypeptide provided herein, such as any encoding a polypeptide set forth in any of SEQ ID NOS: 4-133 or 417-546, or a mature, zymogen, active or catalytically active form thereof. In one embodiment, nucleic acid molecules provided herein have at least 50, 60, 65, 70, 75, 80, 85, 90, 91, 92, 93, 94, 95, or 99% sequence identity or hybridize under conditions of medium or high stringency along at least 70% of the full-length of any nucleic acid encoding a FX polypeptide provided herein. In another embodiment, a nucleic acid molecule can include those with degenerate codon sequences encoding any of the FX polypeptides provided herein.

F. Assessing Modified FX Activities

The activities and properties of FX polypeptides can be assessed in vitro and/or in vivo. Assays for such assessment are known to those of skill in the art and are known to correlate tested activities and results to therapeutic and in vivo activities. In one example, FX variants can be assessed in comparison to unmodified and/or wild-type FX. In another example, the activity of modified FX polypeptides can be assessed following exposure in vitro or in vivo to AT-III and compared with those of modified FX polypeptides that have not been exposed to AT-III. Such assays can be performed in the presence or absence of FVa. In vitro assays include any laboratory assay known to one of skill in the art, such as for example, cell-based assays including coagulation assays, binding assays, protein assays, and molecular biology assays. In vivo assays include FX assays in animal models as well as administration to humans. In some cases, activity of FX in vivo can be determined by assessing blood, serum, or other bodily fluid for assay determinants. FX variants also can be tested in vivo to assess an activity or property, such as therapeutic effect.

Typically, assays described herein are with respect to the activated form of FX, i.e. FXa. Such assays also can be performed with the inactive, zymogen form, such as to provide a negative control since such form typically does not contain proteolytic or catalytic activity required for the coagulant activity of FX. In addition, such assays also can be performed in the presence of cofactors, such as FVa, which in some instances augments the activity of FX.

1. In Vitro Assays

Exemplary in vitro assays include assays to assess polypeptide modification and activity. Modifications can be assessed using in vitro assays that assess γ-carboxylation and other post-translational modifications, protein assays and conformational assays known in the art. Assays for activity include, but are not limited to, measurement of FXa interaction with other coagulation factors, such as Factor Va and prothrombin, proteolytic assays to determine the proteolytic activity of FXa polypeptides, assays to determine the binding and/or affinity of FXa polypeptides for phosphatidylserines and other phospholipids, and cell based assays to determine the effect of FXa polypeptides on coagulation.

Concentrations of modified FXa polypeptides can be assessed by methods well-known in the art, including but not limited to, enzyme-linked immunosorbant assays (ELISA), SDS-PAGE; Bradford, Lowry, and bicinchoninic acid (BCA) methods; UV absorbance; and other quantifiable protein labeling methods, such as, but not limited to, immunological, radioactive and fluorescent methods and related methods. Assessment of cleavage products of proteolysis reactions, including cleavage of prothrombin polypeptides or products produced by FXa protease activity, can be performed using methods including, but not limited to, chromogenic substrate cleavage, HPLC, SDS-PAGE analysis, ELISA, Western blotting, immunohistochemistry, immunoprecipitation, NH2-terminal sequencing, and protein labeling.

Structural properties of modified FXa polypeptides can also be assessed. For example, X-ray crystallography, nuclear magnetic resonance (NMR), and cryoelectron microscopy (cryo-EM) of modified FX polypeptides can be performed to assess three-dimensional structure of the FX polypeptides and/or other properties of FX polypeptides, such as substrate, $Ca^{2+}$, or cofactor binding.

Additionally, the presence and extent of FXa degradation can be measured by standard techniques such as sodium dodecyl sulfate polyacrylamide gel electrophoresis (SDS-PAGE), and Western blotting of electrophoresed FXa-containing samples. FXa polypeptides that have been exposed to proteases can also be subjected to N-terminal sequencing to determine location or changes in cleavage sites of the modified FXa polypeptides.

a. Post-Translational Modification

FX/FXa polypeptides also can be assessed for the presence of post-translational modifications. Such assays are known in the art and include assays to measure glycosylation, hydroxylation, and carboxylation. In an exemplary assay for glycosylation, carbohydrate analysis can be performed, for example, with SDS page analysis of FX/FXa polypeptides exposed to hydrazinolysis or endoglycosidase treatment. Hydrazinolysis releases N- and O-linked glycans from glycoproteins by incubation with anhydrous hydrazine, while endoglycosidase release involves PNGase F, which releases most N-glycans from glycoproteins. Hydrazinolysis or endoglycosidase treatment of FX/FXa polypeptides generates a reducing terminus that can be tagged with a fluorophore or chromophore label. Labeled FX/FXa polypeptides can be analyzed by fluorophore-assisted carbohydrate electrophoresis (FACE). The fluorescent tag for glycans also can be used for monosaccharide analysis, profiling or fingerprinting of complex glycosylation patterns by HPLC. Exemplary HPLC methods include hydrophilic interaction chromatography, electronic interaction, ion-exchange, hydrophobic interaction, and size-exclusion chromatography. Exemplary glycan probes include, but are not limited to, 3-(acetylamino)-6-aminoacridine (AA-Ac) and 2-aminobenzoic acid (2-AA). Carbohydrate moieties can also be detected through use of specific antibodies that recognize the glycosylated FX/FXa polypeptide.

An exemplary assay to measure β-hydroxylation comprises reverse phase HPLC analysis of FX/FXa polypeptides that have been subjected to alkaline hydrolysis (Fernlund, P and J. Stenflo (1983) *J. Biol. Chem.* 258(20):12509-12). Carboxylation and γ-carboxylation of FX/FXa polypeptides can be assessed using alkaline hydrolysis followed by HPLC using a cation exchange column, and the modified residues can be identified following amino-terminal sequencing analysis using Edman degradation (Camire et al. (2000) *Biochemistry.* 39(46):14322-14329). The interaction of an FX polypeptide containing the propeptide (pro-FX) with the carboxylase responsible for post-translational γ-carboxylate modification also can be assessed. For example, relative affinities of FX peptides for the carboxylase can be compared by determining the inhibition constants ($K_i$) toward a factor IX propeptide/gamma-carboxyglutamic acid domain substrate (Stanley, T. B. (1999) *J. Biol. Chem.* 274:16940-16944).

b. Proteolytic Activity (Catalytic Activity)

Modified FXa polypeptides can be tested for proteolytic activity. The proteolytic activity of FXa can be measured, using chromogenic substrates such as F-3301 ($CH_3OCO$-D-CHA-Gly-Arg-pNA-AcOH; Sigma Aldrich), S-2222 Bz-Ile-Glu(g-OR)-Gly-Arg-pNA.HCl; R=H (50%) and R=$CH_3$ (50%); DiaPharma), S-2337 (benzoyl-Ile-Glu-(γ-piperidyl)-Gly-Arg-p-nitroaniline; Kabi Diagnostica), CBS 39.31 (Diagnostic Stago Ltd.) or fluorogenic substrates such as Pefafluor FXa ($CH_3SO_2$-D-CHA-Gly-Arg-AMC-AcOH; Pentapharm). FXa polypeptides, alone or in the presence of FVa, and optionally in the presence of phospholipids, are incubated with varying concentrations of chromogenic substrate. Cleavage of the substrate can be monitored by absorbance or fluorescence and the rate of substrate hydrolysis determined by linear regression using software readily available.

Factor Xa proteolytic activity also can be assessed indirectly by monitoring the activation of FXa substrates, such as prothrombin. FXa polypeptides in the presence of phospholipids, with or without preincubation with FVa, can be incubated with purified prothrombin (available commercially). The amount of active thrombin produced as a consequence of FXa polypeptide cleavage of prothrombin is then measured as activity of thrombin for a fluorogenic substrate, such as Pefafluor TH(H-D-CHA-Ala-Arg-AMC.2AcOH; Centerchem), which is monitored via fluorescence changes (US 2005/0142032, see also Example 4 below) or a chromogenic substrate, such T3068 (β-Ala-Gly-Arg p-nitroanilide diacetate; Sigma Aldrich), which is monitored by absorbance changes. The Factor Xa polypeptide activity is then deduced from the measured thrombin activity.

c. Coagulation Activity

FX/FXa polypeptides can be tested for coagulation activity by using assays well known in the art. For example, some of the assays include, but are not limited to, a two stage clotting assay (Skogen et al., (1983) J. Biol. Chem. 259(4):2306-2310); the prothrombin time (PT) assay; assays which are modifications of the PT test; the activated partial thromboplastin time (aPTT); activated clotting time (ACT); dilute activated factor X-activated clotting time (XACT) (Exner et al. (2000) *Blood Coagul Fibrinolysis.* 14(8):773-779); recalcified activated clotting time; the Lee-White Clotting time; thromboelastography (TEG); or rotational thromboelastometry (ROTEM). For example, coagulation activity of a modified FX/FXa polypeptide can be determined by a PT-based assay where FX/FXa is diluted in FX-deficient plasma, and mixed with prothrombin time reagent (with phospholipids and calcium), such as that available as Innovin™ from Dade Behring. Clot formation is detected optically and time to clot is determined and compared against FX-deficient plasma alone.

d. Binding to and/or Inhibition by Other Proteins and Molecules

Inhibition assays can be used to measure resistance of modified FXa polypeptides to FXa inhibitors, such as the Antithrombin III (AT-III)/heparin complex. Assessment of inhibition to other inhibitors also can be tested and include, but are not limited to, other serine protease inhibitors, such as Protein Z-depending Protease Inhibitor (ZPI), and FXa-specific antibodies Inhibition can be assessed by incubation of commercially available AT-III and unfractionated heparin with FXa polypeptides. The activity of FXa can then be measured using any one or more of the activity or coagulation assays described above, and inhibition by AT-III or ZPI can be assessed by comparing the activity of FXa polypeptides incubated with the inhibitor, with the activity of FXa polypeptides that were not incubated with the inhibitor.

FXa polypeptides can be tested for binding to other coagulation factors and inhibitors. For example, FXa direct and indirect interactions with cofactors, such as FVa, substrates, such as prothrombin, and inhibitors, such as AT-ER, ZPI, and heparin can be assessed using any binding assay known in the art, including, but not limited to, immunoprecipitation; column purification; non-reducing SDS-PAGE; surface plasmon resonance (SPR), including BIAcore® assays; fluorescence resonance energy transfer (FRET); fluorescence polarization (FP); isothermal titration calorimetry (ITC); circular dichroism (CD); protein fragment complementation assays (PCA); Nuclear Magnetic Resonance (NMR) spectroscopy; light scattering; sedimentation equilibrium; small-zone gel filtration chromatography; gel retardation; Far-western blotting; fluorescence polarization; hydroxyl-radical protein footprinting; phage display; and various two-hybrid systems. In one example, the binding affinity of FXa to phospholipid-bound FVa was determined using radiolabeled FXa and FVa and oil centrifugation (Tracy et al., (1981) *J. Biol. Chem.* 256(2): 743-751).

e. Phospholipid Affinity

Modified FX/FXa polypeptide binding and/or affinity for phosphatidylserine (PS) and other phospholipids can be determined using assays well known in the art (see, e.g. Burri et al., (1987) *Biochimica et Biophysica Acta.* 923(2): 176-186). Highly pure phospholipids (for example, known concentrations of bovine PS and egg phosphatidylcholine (PC), which are commercially available, such as from Sigma, in organic solvent can be used to prepare small unilamellar phospholipid vesicles. FX/FXa polypeptide binding to these PS/PC vesicles can be determined by relative light scattering at 90° to the incident light. The intensity of the light scatter with PC/PS alone and with PC/PS/FX or PC/PS/FXa is measured to determine the dissociation constant (Burri et al., (1987) *Biochimica et Biophysica Acta.* 923(2): 176-186). Surface plasma resonance, such as on a BIAcore biosensor instrument, also can be used to measure the affinity of FX/FXa polypeptides for phospholipid membranes (Erb et al., (2002) *Eur. J. Biochem.* 269(12):3041-3046).

2. Non-Human Animal Models

Non-human animal models can be used to assess activity, efficacy and safety of modified FX/FXa polypeptides. For example, non-human animals can be used as models for a disease or condition. Non-human animals can be injected with disease and/or phenotype-inducing substances, such as an overdose of an anticoagulant therapeutic, prior to administration of FX/FXa variants, such as any FX/FXa variant set forth in Table 14, and in particular the zymogen or FXa, or catalytically active forms thereof, to monitor the effects on hemostasis.

Genetic models also are useful. Animals, such as mice, can be generated which mimic a disease or condition by the overexpression, underexpression or knock-out of one or more genes, such as, for example, factor VIII knock-out mice that display hemophilia A (Bi et al. (1995) *Nat Gen* 10:119-121). Deficiencies in other coagulation factors also can be generated for testing FX/FXa variants, including but not limited to Factor VII deficiency; Factor IX deficiency (e.g., Hemophilia B models); Factor X deficiency; Factor XI deficiency (Hemophilia C models); Factor XII deficiency; and types I, II, IV, V, and VI familial multiple coagulation factor deficiencies (FMFD) (see Roberts, H R and M D Bingham, "Other Coagulation Factor Deficiencies". *Thrombosis and Hemorrhage,*

2nd ed. Baltimore, Md.: Williams & Wilkins, 1998: 773-802). Such animals can be generated by transgenic animal production techniques well-known in the art or using naturally-occurring or induced mutant strains. Examples of useful non-human animal models of diseases associated with FX/FXa include, but are not limited to, models of bleeding disorders, in particular hemophilia, or thrombotic disease. Non-human animal models for injury or trauma, and animal models of post trauma hemodilutional coagulopathy or acute traumatic coagulopathy, also can be used to assess an activity, such as the coagulation activity, of FX/FXa polypeptides. These non-human animal models can be used to monitor activity of FX/FXa variants compared to a wild type FX/FXa polypeptide.

Animal models also can be used to monitor stability, half-life, and clearance of modified FX/FXa polypeptides. Such assays are useful for comparing modified FX/FXa polypeptides and for calculating doses and dose regimens for further non-human animal and human trials. For example, a modified FX/FXa polypeptide, such as any FX/FXa variant provided herein including, for example, any set forth in any of Table 14, and in particular the zymogen, FXa or catalytically active portions thereof, can be injected into the tail vein of mice. Blood samples are then taken at time-points after injection (such as minutes, hours and days afterwards) and then the level of the modified FX/FXa polypeptides in bodily samples including, but not limited to, serum or plasma can be monitored at specific time-points for example by ELISA or radio-immunoassay. Blood samples from various time points following injection of the FX/FXa polypeptides also be tested for coagulation activity using various methods, such as is described in Example 8. These types of pharmacokinetic studies can provide information regarding half-life, clearance and stability of the FX/FXa polypeptides, which can assist in determining suitable dosages for administration as a procoagulant.

Modified FX/FXa polypeptides, such as any set forth in Table 14, and in particular the zymogen, FXa or catalytically active forms thereof, can be tested for therapeutic effectiveness using animal models for hemophilia. In one non-limiting example, an animal model such as a mouse can be used. Mouse models of hemophilia are available in the art and can be employed to test modified FX/FXa polypeptides. For example, a mouse model of hemophilia A that is produced by injection with anti-FVIII antibodies can be used to assess the coagulant activity of coagulation factor polypeptides (e.g., Tranholm et al. Blood (2003)102:3615-3620) and the testing of modified FX/FXa polypeptides in a induced model of hemophilia is contemplated. Genetic mouse models of hemophilia A (Bi et al. (1995) Nat Gen 10:119-121) or hemophilia B (Margaritis et al. (2004) J Clin Invest 113:1025-1031) also can be used to test modified FX/FXa polypeptides.

Non-mouse models of bleeding disorders also exist. FX/FXa polypeptide activity can be assessed in rats with warfarin-induced bleeding or melagatran-induced bleeding (Diness et al. (1992) Thromb. Res 67:233-241, Elg et al. (2001) Thromb. Res. 101:145-157), and rabbits with heparin-induced bleeding (Chan et al. (2003) J. Thromb. Haemost. 1:760-765). Primate models of anticoagulant overdose (Gruber et al., (2008) Blood 112: Abstract 3825) also can be used to test modified FX/FXa polypeptide activity. Inbred hemophilia A, hemophilia B and von Willebrand disease dogs that display severe bleeding (Brinkhous et al. (1989) PNAS 86:1382-1386) also can be used in non-human animal studies with modified FX/FXa polypeptides. The activity of FX/FXa polypeptides also can be assessed in a rabbit model of bleeding in which thrombocytopenia is induced by a combination of gamma-irradiation and the use of platelet antibodies (Tranholm et al. (2003) Thromb. Res. 109:217-223).

In addition to animals with generalized bleeding disorders, injury and trauma models of acquired coagulopathy also can be used to evaluate the activity of modified FX/FXa polypeptides, and their safety and efficacy as a coagulant therapeutic. Non-limiting examples of such models include a rabbit coronary stenosis model (Fatorutto et al. (2004) Can J Anaesth; 51:672-679), a grade V liver injury model in pigs (Kopelman et al. (2000) Cryobiology; 40:210-217; Martinowitz et al. (2001) J Trauma; 50:721-729), a pig aortotomy model (Sondeen et al. (2004) Shock; 22:163-168), a pig model of acquired coagulopathy of trauma (Harr et al., (2011) J Surg Res; 170(2):319-324); and a pig model of acquired coagulopathy of trauma (Dickneite, G. and I. Pragst, (2009) Br J Anaesth; 102(3):345-354).

3. Clinical Assays

Many assays are available to assess activity of FX/FXa for clinical use. Such assays can include assessment of coagulation, protein stability and half-life in vivo, and phenotypic assays. Phenotypic assays and assays to assess the therapeutic effect of FX/FXa treatment include assessment of blood levels of FX/FXa (e.g. measurement of serum FX/FXa prior to administration and time-points following administrations including, after the first administration, immediately after last administration, and time-points in between, correcting for the body mass index (BMI)), assessment of blood coagulation in vitro using the methods described above following treatment with FX/FXa (e.g. PT assay), and phenotypic response to FX/FXa treatment including amelioration of symptoms over time compared to subjects treated with an unmodified and/or wild type FX/FXa or placebo. Patients treated with modified FX/FXa polypeptides can be monitored for blood loss, transfusion requirement, and hemoglobin. Patients can be monitored regularly over a period of time for routine or repeated administrations, or following administration in response to acute events, such as hemorrhage, trauma, or surgical procedures.

G. Formulations and Administration

Compositions of modified FX polypeptides, including modified FX zymogen and modified FXa polypeptides, for use in treatment of bleeding disorders are provided herein. Such compositions contain a therapeutically effective amount of a modified FX zymogen or FXa polypeptide as described herein. Effective concentrations of FX polypeptides or pharmaceutically acceptable derivatives thereof are mixed with a suitable pharmaceutical carrier or vehicle for systemic, topical or local administration. Compounds are included in an amount effective for treating the selected disorder. The concentration of active compound in the composition will depend on absorption, inactivation, excretion rates of the active compound, the dosage schedule, and amount administered as well as other factors known to those of skill in the art.

Pharmaceutical carriers or vehicles suitable for administration of the compounds provided herein include any such carriers known to those skilled in the art to be suitable for the particular mode of administration. Pharmaceutical compositions that include a therapeutically effective amount of a FX polypeptide described herein also can be provided as a lyophilized powder that is reconstituted, such as with sterile water, immediately prior to administration.

1. Formulations

Pharmaceutical compositions containing a modified FX polypeptide, including modified FX zymogen and modified FXa polypeptides, can be formulated in any conventional manner by mixing a selected amount of the polypeptide with one or more physiologically acceptable carriers or excipients. Selection of the carrier or excipient is within the skill of the administering profession and can depend upon a number of parameters. These include, for example, the mode of administration (i.e., systemic, oral, nasal, pulmonary, local, topical, or any other mode) and disorder treated.

The compound can be suspended in micronized or other suitable form or can be derivatized to produce a more soluble active product. The form of the resulting mixture depends upon a number of factors, including the intended mode of administration and the solubility of the compound in the selected carrier or vehicle. The resulting mixtures are solutions, suspensions, emulsions and other such mixtures, and can be formulated as an non-aqueous or aqueous mixture, creams, gels, ointments, emulsions, solutions, elixirs, lotions, suspensions, tinctures, pastes, foams, aerosols, irrigations, sprays, suppositories, bandages, or any other formulation suitable for systemic, topical or local administration. For local internal administration, such as, intramuscular, parenteral or intra-articular administration, the polypeptides can be formulated as a solution suspension in an aqueous-based medium, such as isotonically buffered saline or are combined with a biocompatible support or bioadhesive intended for internal administration.

Generally, pharmaceutically acceptable compositions are prepared in view of approvals for a regulatory agency or are prepared in accordance with generally recognized pharmacopeia for use in animals and in humans. Pharmaceutical compositions can include carriers such as a diluent, adjuvant, excipient, or vehicle with which an isoform is administered. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acaciagelatin, glucose, molasses, polyinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. A composition, if desired, also can contain minor amounts of wetting or emulsifying agents, or pH buffering agents, for example, acetate, sodium citrate, cyclodextrine derivatives, sorbitan monolaurate, triethanolamine sodium acetate, triethanolamine oleate, and other such agents. These compositions can take the form of solutions, suspensions, emulsion, tablets, pills, capsules, powders, and sustained release formulations. Capsules and cartridges of e.g., gelatin for use in an inhaler or insufflator can be formulated containing a powder mix of a therapeutic compound and a suitable powder base such as lactose or starch. A composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, and other such agents. Preparations for oral administration also can be suitably formulated with protease inhibitors, such as a Bowman-Birk inhibitor, a conjugated Bowman-Birk inhibitor, aprotinin and camostat. Examples of suitable pharmaceutical carriers are described in "Remington's Pharmaceutical Sciences" by E. W. Martin. Such compositions will contain a therapeutically effective amount of the compound, generally in purified form, together with a suitable amount of carrier so as to provide the form for proper administration to a subject or patient.

The formulation should suit the mode of administration. For example, compositions containing the modified FX, including modified FX zymogen and modified FXa polypeptides, can be formulated for parenteral administration by injection (e.g., by bolus injection or continuous infusion). The injectable compositions can take such forms as suspensions, solutions or emulsions in oily or aqueous vehicles. The sterile injectable preparation also can be a sterile injectable solution or suspension in a non-toxic parenterally-acceptable diluent or solvent, for example, as a solution in 1,4-butanediol. Sterile, fixed oils are conventionally employed as a solvent or suspending medium. For this purpose any bland fixed oil can be employed, including, but not limited to, synthetic mono- or diglycerides, fatty acids (including oleic acid), naturally occurring vegetable oils like sesame oil, coconut oil, peanut. oil, cottonseed oil, and other oils, or synthetic fatty vehicles like ethyl oleate. Buffers, preservatives, antioxidants, and the suitable ingredients, can be incorporated as required, or, alternatively, can comprise the formulation.

The polypeptides can be formulated as the sole pharmaceutically active ingredient in the composition or can be combined with other active ingredients. The polypeptides can be targeted for delivery, such as by conjugation to a targeting agent, such as an antibody. Liposomal suspensions, including tissue-targeted liposomes, also can be suitable as pharmaceutically acceptable carriers. These can be prepared according to methods known to those skilled in the art. For example, liposome formulations can be prepared as described in U.S. Pat. No. 4,522,811. Liposomal delivery also can include slow release formulations, including pharmaceutical matrices such as collagen gels and liposomes modified with fibronectin (see, for example, Weiner et al. (1985) J Pharm Sci. 74(9): 922-5). The compositions provided herein further can contain one or more adjuvants that facilitate delivery, such as, but are not limited to, inert carriers, or colloidal dispersion systems. Representative and non-limiting examples of such inert carriers can be selected from water, isopropyl alcohol, gaseous fluorocarbons, ethyl alcohol, polyvinyl pyrrolidone, propylene glycol, a gel-producing material, stearyl alcohol, stearic acid, spermaceti, sorbitan monooleate, methylcellulose, as well as suitable combinations of two or more thereof. The active compound is included in the pharmaceutically acceptable carrier in an amount sufficient to exert a therapeutically useful effect in the absence of undesirable side effects on the subject treated. The therapeutically effective concentration can be determined empirically by testing the compounds in known in vitro and in vivo systems, such as the assays provided herein.

a. Dosages

The pharmaceutical compositions containing a modified FX polypeptide, including modified FX zymogen and modified FXa polypeptides, provided herein can be formulated for single dosage (direct) administration, multiple dosage administration or for dilution or other modification. The concentrations of the compounds in the formulations are effective for delivery of an amount, upon administration, that is effective for the intended treatment. Typically, the compositions are formulated for single dosage administration. To formulate a composition, the weight fraction of a compound or mixture thereof is dissolved, suspended, dispersed, or otherwise mixed in a selected vehicle at an effective concentration such that the treated condition is relieved or ameliorated.

The precise amount or dose of the therapeutic agent administered depends on the particular FX polypeptide (e.g. FX zymogen or FXa and/or the particular modification), the route of administration, and other considerations, such as the severity of the disease and the weight and general state of the subject. Local administration of the therapeutic agent will typically require a smaller dosage than any mode of systemic administration, although the local concentration of the therapeutic agent can, in some cases, be higher following local administration than can be achieved with safety upon systemic administration.

If necessary, a particular dosage and duration and treatment protocol can be empirically determined or extrapolated. For example, exemplary doses of recombinant and native FX polypeptides can be used as a starting point to determine appropriate dosages. Generally, the modified FX polypeptides provided herein can be effective at reduced dosage amounts and/or frequencies compared to a recombinant wild-type FX polypeptide. The duration of treatment and the interval between injections will vary with the severity of the bleed and the response of the patient to the treatment, and can be adjusted accordingly. Factors such as the level of activity and half-life of the modified FX in comparison to the unmodified FX can be taken into account when making dosage determinations. Particular dosages and regimens can be empirically determined. For example, a modified FX polypeptide that exhibits a longer half-life than an unmodified FX polypeptide can be administered at lower doses and/or less frequently than the unmodified FX polypeptide. Similarly, the dosages required for therapeutic effect using a modified FX polypeptide that displays increased coagulant activity compared with an unmodified FX polypeptide can be reduced in frequency and amount. Particular dosages and regimens can be empirically determined by one of skill in the art.

The dosage amount of modified FX polypeptide, including FX zymogen or FXa, can be an amount that elevates blood levels of the polypeptide to from about 10% to about 400%, 50% to 100% or 100% to 250% of the normal amount of the FX polypeptide form. It is within the level of one of skill in the art to monitor the plasma or blood level for the administered FX polypeptide to monitor or adjust dosage level.

The composition can be formulated with a FX polypeptide in an amount that is from or from about 50 Units/mL to 1000 Units/mL, such as 50 Units/mL to 500 Units/mL, 100 Units/mL to 600 Units/mL or 400 Units/mL to 1000 Units/mL. The volume of the compositions can be 0.5 mL to 100 mL, such as 0.5 mL to 5 mL, 1 mL to 10 mL, 5 mL to 50 mL or 30 mL to 60 mL.

For example, the modified FX polypeptides provided herein can be formulated for administration to a patient at a dosage of 0.01 to 1,000 mg, such as 0.05 to 500 mg, for example 1 mg to 500 mg. An effective amount of the drug is ordinarily supplied at a dosage level from 0.0002 mg/kg to about 20 mg/kg of body weight per day, such as from about 0.001 mg/kg to 7 mg/kg of body weight per day, for example, 0.01 mg/kg to 1 mg/kg, 0.05 mg/kg to 0.5 mg/kg, 0.01 mg/kg to 0.250 mg/kg, 0.01 mg/kg to 0.075 mg/kg or at least or about at least 0.04 mg/kg. Generally, the dosage is at least once a day, at least until a sufficient improvement is observed. The dosage can be effected by bolus infusion over the course of several minutes (e.g. 1 to 10 minutes or 2 to 5 minutes). Alternatively, the patient can receive a bolus infusion every one to three hours, or if sufficient improvement is observed, a once daily infusion of the polypeptide can be effected. Hence, in some examples, the dose can be repeated hourly, daily, weekly or monthly. For example, for treatment of patients experiencing a bleeding episode, such as patients having a coagulation factor deficiency or other associated trauma, the dose can be repeated ever 1-24 hours, such as every 2-12 hours or 4-6 hours, until hemostasis is achieved.

b. Dosage Forms

Pharmaceutical therapeutically active compounds and derivatives thereof are typically formulated and administered in unit dosage forms or multiple dosage forms. Formulations can be provided for administration to humans and animals in dosage forms that include, but are not limited to, tablets, capsules, pills, powders, granules, sterile parenteral solutions or suspensions, oral solutions or suspensions, and oil water emulsions containing suitable quantities of the compounds or pharmaceutically acceptable derivatives thereof. Each unit dose contains a predetermined quantity of therapeutically active compound sufficient to produce the desired therapeutic effect, in association with the required pharmaceutical carrier, vehicle or diluent. Examples of unit dose forms include ampoules and syringes and individually packaged tablets or capsules. In some examples, the unit dose is provided as a lyophilized powder that is reconstituted prior to administration. For example, a FX polypeptide can be provided as lyophilized powder that is reconstituted with a suitable solution to generate a single dose solution for injection. In some embodiments, the lyophilized powder can contain the FX polypeptide and additional components, such as salts, such that reconstitution with sterile distilled water results in a FX polypeptide in a buffered or saline solution. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging.

2. Administration of Modified FX Polypeptides

The modified FX polypeptides, including FX zymogen or FXa polypeptides, provided herein (i.e. active compounds) can be administered in vitro, ex vivo, or in vivo by contacting a mixture, such as a body fluid or other tissue sample, with a modified FX polypeptide. For example, when administering a compound ex vivo, a body fluid or tissue sample from a subject can be contacted with the FX polypeptides that are coated on a tube or filter, such as for example, a tube or filter in a bypass machine. When administering in vivo, the active compounds can be administered by any appropriate route, for example, orally, nasally, pulmonary, parenterally, intravenously, intradermally, subcutaneously, intraarticularly, intracisternally, intraocularly, intraventricularly, intrathecally, intramuscularly, intraperitoneally, intratracheally or topically, as well as by any combination of any two or more thereof, in liquid, semi-liquid or solid form and are formulated in a manner suitable for each route of administration. The modified FX polypeptides can be administered once or more than once, such as twice, three times, four times, or any number of times that are required to achieve a therapeutic effect. Multiple administrations can be effected via any route or combination of routes, and can be administered hourly (e.g. every 2 hours, every three hours, every four hours or more), daily, weekly or monthly.

The most suitable route for administration will vary depending upon the disease state to be treated, for example the location of the bleeding disorder. Generally, the FX polypeptides will be administered by intravenous bolus injection. The administration (infusing) time can be over the course of several minutes, such as approximately 1 to 10 minutes or 2 to 5 minutes. In other examples, desirable blood levels of FX can be maintained by a continuous infusion of the active agent as ascertained by plasma levels. It should be noted that the attending physician would know how to and when to terminate, interrupt or adjust therapy to lower dosage due to toxicity, or bone marrow, liver or kidney dysfunctions. Conversely, the attending physician would also know how to and when to adjust treatment to higher levels if the clinical response is not adequate (precluding toxic side effects).

In other examples, the location of the bleeding disorder might indicate that the FX formulation is administered via alternative routes. For example, local administration, including administration into the brain (e.g., intraventricularly) might be performed when the patient is experiencing bleeding in this region. Similarly, for treatment of bleeding in the joints, local administration by injection of the therapeutic agent into the joint (i.e., intraarticularly, intravenous or subcutaneous means) can be employed. In other examples, topical administration of the therapeutic agent to the skin, for example formulated as a cream, gel, or ointment, or administration to the lungs by inhalation or intratracheally, might be appropriate when the bleeding is localized to these areas.

In examples where the modified FX polypeptides are be formulated as a depot preparation, the long-acting formulations can be administered by implantation (for example, subcutaneously or intramuscularly) or by intramuscular injection. Thus, for example, the therapeutic compounds can be formulated with suitable polymeric or hydrophobic materials (for example as an emulsion in an acceptable oil) or ion exchange resins, or as sparingly soluble derivatives, for example, as a sparingly soluble salt.

The compositions, if desired, can be presented in a package, in a kit or dispenser device, that can contain one or more unit dosage forms containing the active ingredient. The package, for example, contains metal or plastic foil, such as a blister pack. The pack or dispenser device can be accompanied by instructions for administration. The compositions containing the active agents can be packaged as articles of manufacture containing packaging material, an agent provided herein, and a label that indicates the disorder for which the agent is provided.

3. Administration of Nucleic Acids Encoding Modified FX Polypeptides (Gene Therapy)

Also provided are compositions of nucleic acid molecules encoding the modified FX polypeptides and expression vectors encoding them that are suitable for gene therapy. Rather than deliver the protein, nucleic acid can be administered in vivo, such as systemically or by other route, or ex vivo, such as by removal of cells, including lymphocytes, introduction of the nucleic therein, and reintroduction into the host or a compatible recipient.

Modified FX polypeptides can be delivered to cells and tissues by expression of nucleic acid molecules. Modified FX polypeptides can be administered as nucleic acid molecules encoding modified FX polypeptides, including ex vivo techniques and direct in vivo expression. Nucleic acids can be delivered to cells and tissues by any method known to those of skill in the art. The isolated nucleic acid sequences can be incorporated into vectors for further manipulation. As used herein, vector (or plasmid) refers to discrete elements that are used to introduce heterologous DNA into cells for either expression or replication thereof. Selection and use of such vehicles are well within the skill of the artisan.

Methods for administering modified FX polypeptides by expression of encoding nucleic acid molecules include administration of recombinant vectors. The vector can be designed to remain episomal, such as by inclusion of an origin of replication or can be designed to integrate into a chromosome in the cell. Modified FX polypeptides also can be used in ex vivo gene expression therapy using non-viral vectors. For example, cells can be engineered to express a modified FX polypeptide, such as by integrating a modified FX polypeptide encoding-nucleic acid into a genomic location, either operatively linked to regulatory sequences or such that it is placed operatively linked to regulatory sequences in a genomic location. Such cells then can be administered locally or systemically to a subject, such as a patient in need of treatment.

Viral vectors, include, for example adenoviruses, adeno-associated viruses (AAV), poxviruses, herpes viruses, retroviruses and others designed for gene therapy can be employed. The vectors can remain episomal or can integrate into chromosomes of the treated subject. A modified FX polypeptide can be expressed by a virus, which is administered to a subject in need of treatment. Viral vectors suitable for gene therapy include adenovirus, adeno-associated virus (AAV), retroviruses, lentiviruses, vaccinia viruses and others noted above. For example, adenovirus expression technology is well-known in the art and adenovirus production and administration methods also are well known. Adenovirus serotypes are available, for example, from the American Type Culture Collection (ATCC, Rockville, Md.). Adenovirus can be used ex vivo, for example, cells are isolated from a patient in need of treatment, and transduced with a modified FX polypeptide-expressing adenovirus vector. After a suitable culturing period, the transduced cells are administered to a subject, locally and/or systemically. Alternatively, modified FX polypeptide-expressing adenovirus particles are isolated and formulated in a pharmaceutically-acceptable carrier for delivery of a therapeutically effective amount to prevent, treat or ameliorate a disease or condition of a subject. Typically, adenovirus particles are delivered at a dose ranging from 1 particle to $10^{14}$ particles per kilogram subject weight, generally between $10^6$ or $10^8$ particles to $10^{12}$ particles per kilogram subject weight.

In some situations it is desirable to provide a nucleic acid source with an agent that targets cells, such as an antibody specific for a cell surface membrane protein or a target cell, or a ligand for a receptor on a target cell. FX also can be targeted for delivery into specific cell types. For example, adenoviral vectors encoding FX polypeptides can be used for stable expression in nondividing cells, such as liver cells (Margaritis et al. (2004) J Clin Invest 113:1025-1031). In another example, viral or nonviral vectors encoding FX polypeptides can be transduced into isolated cells for subsequent delivery. Additional cell types for expression and delivery of FX can include, but are not limited to, fibroblasts and endothelial cells.

The nucleic acid molecules can be introduced into artificial chromosomes and other non-viral vectors. Artificial chromosomes, such as ACES (see, Lindenbaum et al. (2004) Nucleic Acids Res. 32(21):e172) can be engineered to encode and express the isoform. Briefly, mammalian artificial chromosomes (MACs) provide a means to introduce large payloads of genetic information into the cell in an autonomously replicating, non-integrating format. Unique among MACs, the mammalian satellite DNA-based Artificial Chromosome Expression (ACE) can be reproducibly generated de novo in cell lines of different species and readily purified from the host cells' chromosomes. Purified mammalian ACEs can then be re-introduced into a variety of recipient cell lines where they have been stably maintained for extended periods in the absence of selective pressure using an ACE System. Using this approach, specific loading of one or two gene targets has been achieved in LMTK(−) and CHO cells.

Another method for introducing nucleic acids encoding the modified FX polypeptides is a two-step gene replacement technique in yeast, starting with a complete adenovirus genome (Ad2; Ketner et al. (1994) PNAS 91: 6186-6190) cloned in a Yeast Artificial Chromosome (YAC) and a plasmid containing adenovirus sequence's to target a specific region in the YAC clone, an expression cassette for the gene of interest and a positive and negative selectable marker. YACs are of particular interest because they permit incorporation of larger genes. This approach can be used for construction of adenovirus-based vectors bearing nucleic acids encoding any of the described modified FX polypeptides for gene transfer to mammalian cells or whole animals.

The nucleic acids can be encapsulated in a vehicle, such as a liposome, or introduced into a cells, such as a bacterial cell, particularly an attenuated bacterium or introduced into a viral vector. For example, when liposomes are employed, proteins that bind to a cell surface membrane protein associated with endocytosis can be used for targeting and/or to facilitate uptake, e.g. capsid proteins or fragments thereof tropic for a particular cell type, antibodies for proteins which undergo internalization in cycling, and proteins that target intracellular localization and enhance intracellular half-life.

For ex vivo and in vivo methods, nucleic acid molecules encoding the modified FX polypeptide is introduced into cells that are from a suitable donor or the subject to be treated. Cells into which a nucleic acid can be introduced for purposes of therapy include, for example, any desired, available cell type appropriate for the disease or condition to be treated, including but not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., such as stem cells obtained from bone marrow, umbilical cord blood, peripheral blood, fetal liver, and other sources thereof.

For ex vivo treatment, cells from a donor compatible with the subject to be treated or the subject to be treated cells are removed, the nucleic acid is introduced into these isolated cells and the modified cells are administered to the subject. Treatment includes direct administration, such as, for example, encapsulated within porous membranes, which are implanted into the patient (see, e.g., U.S. Pat. Nos. 4,892,538 and 5,283,187 each of which is herein incorporated by reference in its entirety). Techniques suitable for the transfer of nucleic acid into mammalian cells in vitro include the use of liposomes and cationic lipids (e.g., DOTMA, DOPE and DC-Chol) electroporation, microinjection, cell fusion, DEAE-dextran, and calcium phosphate precipitation methods. Methods of DNA delivery can be used to express modified FX polypeptides in vivo. Such methods include liposome delivery of nucleic acids and naked DNA delivery, including local and systemic delivery such as using electroporation, ultrasound and calcium-phosphate delivery. Other techniques include microinjection, cell fusion, chromosome-mediated gene transfer, microcell-mediated gene transfer and spheroplast fusion.

In vivo expression of a modified FX polypeptide can be linked to expression of additional molecules. For example, expression of a modified FX polypeptide can be linked with expression of a cytotoxic product such as in an engineered virus or expressed in a cytotoxic virus. Such viruses can be targeted to a particular cell type that is a target for a therapeutic effect. The expressed modified FX polypeptide can be used to enhance the cytotoxicity of the virus.

In vivo expression of a modified FX polypeptide can include operatively linking a modified FX polypeptide encoding nucleic acid molecule to specific regulatory sequences such as a cell-specific or tissue-specific promoter. Modified FX polypeptides also can be expressed from vectors that specifically infect and/or replicate in target cell types and/or tissues. Inducible promoters can be use to selectively regulate modified FX polypeptide expression. An exemplary regulatable expression system is the doxycycline-inducible gene expression system, which has been used to regulate recombinant FX expression (Srour et al. (2003) Thromb Haemost. 90(3): 398-405).

Nucleic acid molecules, as naked nucleic acids or in vectors, artificial chromosomes, liposomes and other vehicles can be administered to the subject by systemic administration, topical, local and other routes of administration. When systemic and in vivo, the nucleic acid molecule or vehicle containing the nucleic acid molecule can be targeted to a cell.

Administration also can be direct, such as by administration of a vector or cells that typically targets a cell or tissue. For example, tumor cells and proliferating can be targeted cells for in vivo expression of modified FX polypeptides. Cells used for in vivo expression of an modified FX polypeptide also include cells autologous to the patient. Such cells can be removed from a patient, nucleic acids for expression of an modified FX polypeptide introduced, and then administered to a patient such as by injection or engraftment.

H. Therapeutic Uses

The modified FX/FXa polypeptides provided herein can be used in various therapeutic as well as diagnostic methods in which FX zymogen or FXa is employed. Such methods include, but are not limited to, methods of treatment of physiological and medical conditions described and listed below. Typically, such treatments include those where increased coagulation, such as increased hemostatic responses, are desired. For example, the modified polypeptides provided herein can be used in the treatments of bleeding disorders, for example, as occur in patients with hemophilia. FX/FXa polypeptides are particularly suited for treating patients coagulation factor deficiencies, including but not limited to hemophilia A (Factor VIII deficiency), hemophilia B (Factor IX deficiency) or hemophilia C (Factor XI deficiency), because of its central role in the coagulation pathway, thereby bypassing the requirement for the deficient factors. The modified polypeptides provided herein also can be used in conjunction with surgery or other trauma.

In the methods herein, either the FX zymogen or the FXa form or a catalytically active fragment thereof of any of the modified FX polypeptides provided herein can be administered to a subject. The modified polypeptides provided herein are designed to retain therapeutic activity but exhibit modified properties, particularly increased co-factor dependency, increased catalytic activity, increased substrate affinity, altered glycosylation and/or increased resistance to AT-III. Such modified properties, for example, can improve the therapeutic effectiveness of the polypeptides due to increased coagulant activity of the modified FX/FXa polypeptides that is limited to the presence of co-factor. The altered properties also can result in increased half-life. Modified FX/FXa polypeptides provided herein can exhibit improvement of in vivo activities and therapeutic effects compared to wild-type FX/FXa, including lower dosage to achieve the same effect, and other improvements in administration and treatment such as fewer and/or less frequent administrations, decreased side effects and increased therapeutic effects.

For example, practical limitations have restricted the clinical use of FXa polypeptides, including unmodified FXa polypeptides, as a bypassing strategy for the treatment of blood disorders. For example, circulating unmodified FXa is rapidly inactivated by endogenous, circulating protease inhibitors, reducing the biological FX half-life of 20-40 hr (Roberts et al., (1965) *Thromb Diath Haemorrh.* 13:305-313) to less than 1-2 min (Gitel et al., (1984) *J Biol Chem.* 259: 6890-6895). In addition, pathological activation of coagulation is a concern with administration of FXa polypeptides alone or in pharmaceutical compositions (Gitel et al., (1984) *J Biol. Chem.* 259:6890-6895; lechler (1999) *Thromb Res.* 95(Suppl. 1):S39-S50). This is evidenced by the fact that administration of FXa polypeptides can be used to generate animal models of disseminated intravascular coagulation (DIC) (Kruithof et al., (1997) *Thrombosis and Haemostasis.* 77(2):308-311; Giles et al., (1984) *J Clin Invest.* 74:2219-2225).

The modified FX polypeptides described herein have been modified to address the limitations of clinical use of FXa polypeptides. To prevent excessive clotting upon FX polypeptide administration, the modified FX polypeptides described herein are modified to exhibit increased co-factor dependency of the FXa form (see Example 4) to restrict modified FXa polypeptide activity such that the FXa polypeptides exhibit minimal to no activity unless activated co-factor FVa is present. The limitation of modified FXa polypeptide activity, based on FVa availability and association, reduces or eliminates thrombosis risk associated with unmodified FXa polypeptide treatments. Importantly, in the presence of FVa, however, the modified FXa polypeptides described herein demonstrate normal, and in some cases greater than normal, catalytic activity. The modified FX polypeptides, including modified FXa polypeptides, herein can exhibit improved pharmacokinetic and pharmacodynamic properties, such as improved serum half-life, increased resistance to inhibitors, increased catalytic activity, and/or increased coagulant activity compared to unmodified FXa polypeptides, while increased co-factor dependence of the modified FXa polypeptides described herein reduce or eliminate unwanted clotting.

In some examples, methods of treatment of a FX polypeptide, including a FX zymogen or FXa form, requires a longer duration of action in order to effect a sustained therapeutic effect. This is particularly true in treatment of hemophilia patients and other congenital or chronic bleeding disorders. As discussed elsewhere herein, the half-life of FXa is less than 40 hours, in part due to inhibition by inhibitors such as AT-III. Modified FX polypeptides provided herein that exhibit AT-III resistance and/or that are hyperglcosylated by introduction of non-native glycosylation sites can exhibit increased half-life. Thus, such modified FX polypeptides described herein can be used to deliver longer lasting therapies for clotting disorders.

In particular, modified FX/FXa polypeptides are intended for use in therapeutic methods in which FX/FXa can be used for treatment. Typically, the modified FX polypeptides provided herein are procoagulants and can be used to treat bleeding disorders, including congenital bleeding disorders and acquired bleeding disorders. Exemplary diseases and disorders, such as, but not limited to, blood coagulation disorders, hematologic disorders, hemorrhagic disorders, hemophilias, coagulation factor deficiencies, and acquired blood disorders including bleeding associated with trauma and surgery. In some examples, the bleedings to be treated by FX/FXa polypeptides occur in organs such as the brain, inner ear region, eyes, liver, lung, tumor tissue, gastrointestinal tract. In other embodiments, the bleeding is diffuse, such as in hemorrhagic gastritis and profuse uterine bleeding, such as in postpartum women.

Patients with bleeding disorders, such as for example, hemophilia A and B, often are at risk of bleeding complications during surgery or trauma. Such bleeding can be manifested as acute hemarthroses (bleedings in joints), chronic hemophilic arthropathy, hematomas, (e.g., muscular, retroperitoneal, sublingual and retropharyngeal), hematuria (bleeding from the renal tract), central nervous system bleedings, gastrointestinal bleedings (e.g., UGI bleeds) and cerebral hemorrhage, which also can be treated with modified FX/FXa polypeptides. Additionally, any bleeding associated with a trauma, such as a surgery (e.g., hepatectomy), or dental extraction can be treated with modified FX/FXa polypeptides.

Treatment of diseases and conditions with modified FX/FXa polypeptides can be effected by any suitable route of administration using suitable formulations as described herein including, but not limited to, injection, pulmonary, oral and transdermal administration. Treatment typically is effected by intravenous bolus administration.

If necessary, a particular dosage and duration and treatment protocol can be empirically determined or extrapolated. Dosages for wild-type or unmodified FX zymogen or FXa polypeptides can be used as guidance for determining dosages for modified FX zymogen or FXa polypeptides. Dosages for modified FX zymogen or FXa polypeptides can also be determined or extrapolated from relevant animal studies. Factors such as the level of activity and half-life of the modified FX/FXa in comparison to the unmodified FX/FXa can be used in making such determinations. Particular dosages and regimens can be empirically determined based on a variety of factors. Such factors include body weight of the individual, general health, age, the activity of the specific compound employed, sex, diet, time of administration, rate of excretion, drug combination, the severity and course of the disease, and the patient's disposition to the disease and the judgment of the treating physician. The active ingredient, the polypeptide, typically is combined with a pharmaceutically effective carrier. The amount of active ingredient that can be combined with the carrier materials to produce a single dosage form or multi-dosage form can vary depending upon the host treated and the particular mode of administration.

In some examples, the inactive zymogen form of modified FX polypeptides can be administered to control pathological bleeding. For example, FX polypeptides can be administered at a dosage of about 50 to 800 units/ml, wherein the specific activity of the FX zymogen is about 20 to 130 units/mg protein (U.S. Pat. No. 4,501,731). In cases in which the zymogen form of modified FX polypeptides is administered, endogenous tenase complexes cleave the administered FX zymogen, rendering activated FX (FXa), which confers therapeutic activity.

In some examples, the modified FX polypeptides described herein can be administered to control pathological bleeding in an activated FX form (FXa). For example, purified FX polypeptides can be activated by Russell's Viper Venom FX Activator (Haematologic Technologies) or other coagulation factors, in vitro prior to administration, such as during purification as described in Example 2B. The modified FXa polypeptides provided herein, which are modified to exhibit zymogen-like activity, can be administered at dosages of between 10-1000 µg/kg, such as between about 10-250 m/kg and generally between 10 and 75 µg/kg, such as with 40 µg/kg (see e.g. published U.S. patent application No. US20090175931).

In other examples, the modified FX polypeptides described herein can be administered as a part of a therapeutic composition, for example a composition which does or does not contain direct FX activators. For example, a therapeutic composition can contain other coagulation factors which do not form part of a tenase complex, such as factor II and/or prothrombin. In another example, modified FX polypeptides can be provided in therapeutic compositions which optionally contain FX activating enzymes in active or zymogen forms, such as FVII or FVIIa; FIX or FIXa. FX polypeptides can be administered in combination with activated Factor VII (FVIIa), for example at a ratio of 10:1, to hemophilia patients with inhibitors (Shirahata et al., (2012) *Haemophilia* 18:94-101). In another example, a therapeutic concentrate containing 0.58 IU/ml FX and 0.29 IU/ml FIX can be used to treat coagulopathy induced by an overdose of anticoagulant drugs (Olesen et al., (2009) *J. Thrombosis and Haemostasis* 7(S2): Abstract No. PP-MO-386). In other examples, a modified prothrombin complex concentrate can be generated using modified FX polypeptides and blood clotting factors II, VII, and IX, as well as protein C and protein S.

The effect of the FX/FXa polypeptides on the clotting time of blood can be monitored using any of the clotting tests known in the art including, but not limited to, whole blood prothrombin time (PT), the activated partial thromboplastin time (aPTT), the activated clotting time (ACT), the recalcified activated clotting time, or the Lee-White Clotting time.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms or based upon scheduled dosages. In other cases, additional administrations can be required in response to acute events such as hemorrhage, trauma, or surgical procedures.

Modified FX/FXa polypeptides have therapeutic activity alone or in combination with other agents. This section provides exemplary uses and administration methods. These described therapies are exemplary and do not limit the applications of modified FX/FXa polypeptides. The following are some exemplary conditions for which FX/FXa can be used as a treatment agent alone or in combination with other agents.

1. Congenital Bleeding Disorders

Modified FX zymogen and FXa polypeptides, such as those described herein, can be used to treat congenital bleeding disorders. For example, FX and FXa polypeptides can be used to bypass any coagulation factor in either the intrinsic or extrinsic coagulation pathways, and treat coagulopathy due to the deficiencies thereof. Bleeding disorders resulting from congenital coagulation factor deficiency, include hemophilia A (Factor VIII deficiency); hemophilia B (Factor IX deficiency); hemophilia C (Factor. XI deficiency); Factor VII deficiency; Factor X deficiency; Factor XII deficiency; and types I, II, IV, V, and VI familial multiple coagulation factor deficiencies (FMFD) (see Roberts, H R and M D Bingham, "Other Coagulation Factor Deficiencies," *Thrombosis and Hemorrhage, 2nd ed*. Baltimore, Md.: Williams & Wilkins, 1998: 773-802). Modified FX/FXa polypeptides also can be used in the treatment of additional congenital bleeding diseases and disorders, such as, but not limited to, Von Willebrand's disease, hereditary platelet disorders (e.g., storage pool disease such as Chediak-Higashi and Hermansky-Pudlak syndromes, thromboxane A2 dysfunction, Glanzmann's thrombasthenia, and Bernard-Soulier syndrome), and Hereditary Hemorrhagic Telangiectsasia, also known as Rendu-Osler-Weber syndrome.

a. Hemophilia

Modified FX zymogen and FXa polypeptides, such as those described herein, can be used to treat congenital bleeding disorders, such as hemophilia. Hemophilia is a bleeding disorder that is caused by a deficiency in one or more blood coagulation factors. It is characterized by a decreased ability to form blood clots at sites of tissue damage. Congenital X-linked hemophilias include hemophilia A and hemophilia B, which are caused by mutation(s) resulting in deficiencies in FVIII and FIX, respectively. Hemophilia A occurs at a rate of 1 out of 10,0000 males, while hemophilia B occurs in 1 out of 50,000 males. Hemophilia A and B are further classified as mild, moderate, or severe. A plasma level with 5%-25% of normally functioning factor VIII or IX is classified as mild, 1%-5% is moderate, and less than 1% is severe. Hemophilia C, often referred to as FXI deficiency, is a relatively mild and rare autosomal recessive disease, affecting about 1 in 100000 people.

Patients with hemophilia suffer from recurring joint and muscle bleeds, which can be spontaneous or in response to trauma. The bleeding can cause severe acute pain, restrict movement, and lead to secondary complications including synovial hypertrophy. Furthermore, the recurring bleeding in the joints can cause chronic synovitis, which can cause joint damage, destroying synovium, cartilage, and bone. Bleeding is generally treated with transfusion of fresh frozen plasma (FFP), FXI replacement therapy, or, for topical treatment, such treatment of external wounds or dental extractions, fibrin glue. The most common treatment for hemophilia A or B is replacement therapy, in which the patient is administered FVIII or FIX. The formulations are available commercially as plasma-derived or recombinant products, with recombinant proteins now being the treatment of choice in previously untreated patients. While these therapies can be very successful, complications arise if the patient develops inhibitors to the newly administered factor VIII or factor IX.

Inhibitors are IgG antibodies, mostly of the IgG4 subclass, that react with FVIII or FIX and interfere with pro-coagulant function. Inhibitors affect about 1 in 5 patients with severe hemophilia A. Most subjects develop these inhibitors soon after administration of the first infusions of factor VIII, which is often in early childhood, although subjects develop inhibitors later in life. Inhibitors also affect about 1 in 15 people with mild or moderate hemophilia A. These inhibitors usually develop during adulthood and not only destroy administered exogenous FVIII, but also destroy endogenous FVIII. As a result, mild and moderate hemophiliacs become severe. Clinically, hemophilia A patients with inhibitors are classified into high and low responders according to the strength of the anamnestic response they experience when they are re-exposed to FVIII. Inhibitors affect about 1 in 100 patients with hemophilia B. In most cases, the inhibitors develop after the first infusions of therapeutic factor IX and can be accompanied by allergic reactions.

The modified FX zymogen and FXa polypeptides provided herein and the nucleic acids encoding the modified FX polypeptides provided herein can be used universally in therapies for patients with hemophilia, including hemophilia patients with inhibitors, and can be used for the treatment of bleeding conditions associated with hemophilia. The modified FX polypeptides provided herein can be used, for example, to control or prevent spontaneous bleeding episodes or to control or prevent bleeding in response to trauma or surgical procedures, by enhancing thrombin generation while bypassing the requirement for FVIIIa and/or FIXa.

Modified FX polypeptides can be tested for therapeutic effectiveness, for example, by using animal models. For example, FVIII or FIX-deficient mice, antibody-induced hemophilic mice, or any other known disease model for hemophilia, can be treated with modified FX polypeptides. Progression of disease symptoms and phenotypes is monitored to assess the effects of the modified FX polypeptides. Modified FX polypeptides also can be administered to animal models as well as to subjects, such as in clinical trials, to assess in vivo effectiveness in comparison to placebo controls and/or controls using unmodified FX polypeptides.

b. Other Coagulation Factor Deficiencies

Modified FX zymogen and FXa polypeptides, such as those described herein, also can be used to treat patients with coagulopathy resulting from deficiencies in coagulation factors other than FVIII and FIX. For example, FX polypeptides can be used to treat patients with Factor VII deficiency, Factor X deficiency, Factor XIII deficiency, and types II, IV, V, and VI familial multiple coagulation factor deficiencies (FMFD) (see Roberts, H R and M D Bingham, "Other Coagulation Factor Deficiencies," *Thrombosis and Hemorrhage, 2nd ed*. Baltimore, Md.: Williams & Wilkins, 1998: 773-802).

i. Factor VII Deficiency

Modified FX zymogen and FXa polypeptides, such as those described herein, can be used to in subjects or patients with Factor VII deficiency. Factor VII deficiency is an autosomal recessive bleeding disorder that affects approximately 1 in 500,000 people. FVII deficiency can be clinically mild, moderate or severe, with mild to moderate deficiency characterized by increased bleeding after surgery and trauma. Patients with severe FVII deficiency (less than 1% FVII activity) experience similar symptoms to hemophilia. For example, FVII-deficient subjects are prone to joint bleeds joint bleeds, spontaneous nosebleeds, gastrointestinal bleeding, urinary tract bleeding. Intracerebral hemorrhaging and muscle bleeds have also been reported, while women can experience severe menorrhagia (heavy menstrual bleeding). Treatment can be effected by replacement therapy using plasma, PCCs, and recombinant FVIIa (Hedner et al., (1993) *Transfusion Med Rev,* 7:78-83; US 2009-0291890). The modified FX polypeptides described herein act downstream of FVII in the coagulation pathway, and thus can be used in the treatment of bleeding episodes and the prevention of bleeding in surgical interventions or invasive procedures in FVII-deficient patients. The modified FX polypeptides can be administered in the zymogen form or as activated FX (FXa) polypeptides.

ii. Factor X Deficiency

Modified FX zymogen and FXa polypeptides, such as those described herein, can be used in subjects or patients with Factor X deficiency. Factor X deficiency is a rare autosomal recessive bleeding disorder with an incidence of 1 in 1,000,000 people. Factor X deficiency presents variable bleeding phenotypes ranging from clinically mild (6-10 IU/dL) to severe (<1 IU/dL, or <1% of normal FX activity). Individuals with a factor X activity of 10-15% of normal experience limited spontaneous bleeding, and hemorrhage occurs only in association with surgery or trauma (Peyvandi et al., (1998) *Br J. Haematol.* 102:626-628; Uprichard, J and DJ Perry, (2002) *Blood Reviews.* 16:97-110; Roberts, H R and M D Bingham, "Other Coagulation Factor Deficiencies," *Thrombosis and Hemorrhage, 2nd ed*. Baltimore, Md.: Williams & Wilkins, 1998: 773-802). It is common for FX-deficient patients to experience nosebleeds, and 50% of affected women exhibit menorrhagia. Hemarthroses, severe post-operative hemorrhage and central nervous system hemorrhage have also been reported in patients with severe cases.

Currently, replacement treatment for Factor X deficiency is limited to blood (Girolami et al. (1970) *Thromb Diath Haemorrh* 24(1):175-184), fresh frozen plasma (FFP) (Girolami et al., (1970) *Br J Haematol* 19(2):179-192), and combination therapies, e.g., prothrombinase complex concentrates (PCCs) that contain Factor (Lechler, E (1999) Thromb Res 95(Suppl 1):S39-S50). Combination therapies containing FX, and are further described in Section I. FX polypeptide administration is currently unavailable. The modified FXa polypeptides described herein can be used to treat bleeding episodes and prevent bleeding in surgical interventions or invasive procedures in FX-deficient patients.

iii. Familial Multiple Coagulation Factor Deficiencies

Modified FX zymogen and FXa polypeptides, such as those described herein, also can be used to treat patients with coagulopathy resulting from inherited deficiencies of multiple coagulation factors, also called familial multiple coagulation factor deficiencies (FMFD). There are six types of FMFD which are classified on the basis of which factors are affected. Type I FMFD results from deficiencies in factors V and VIII; type II FMFD results from deficiencies in factors VIII and IX; patients with type III FMFD are deficient in the vitamin K-dependent coagulation factors (i.e., factors II, VII, IX, and X); type IV FMFD results from deficiencies in factors VII and VIII; deficiencies in factors VIII, IX, and XI lead to type V FMFD; and deficiencies in factors IX and XI are classified as type VI FMFD. FMFD types II and IV contain deficiencies in coagulation factors upstream of FX in the coagulation pathways and thus could benefit from treatment with the modified FX polypeptides described herein alone or in combination with other treatments. The FX polypeptides described herein also can be used to treat other types of FMFD, usually as a part of a combination therapy. Of the FMFDs, only type I and type III have been extensively characterized.

Clinical manifestations of type III FMFD ranges from asymptomatic to severe hemorrhage, depending on the degree of factor deficiency or dysfunction. Defects in the gamma glutamyl carboxylase and vitamin K epoxide reductase complex, leading to defects in the carboxylation step during synthesis of FII, FVII, FIX, and FX can produce combined deficiency for these four factors (Brenner et al., (1998) *Blood.* 92:4554-4559; Oldenburg et al., (2000) *Thromb Haemost.* 84:937-941). Type III FMFD is inherited in an autosomal recessive manner. Some individuals with type III FMFD are responsive to large doses of vitamin K (Goldsmith et al., (1982) *J Clin Invest.* 69:1253-1260). However, treatment of bleeding episodes requires therapy to replace the deficient factors (Roberts, H R and M D Bingham, "Other Coagulation Factor Deficiencies," *Thrombosis and Hemorrhage, 2nd ed*. Baltimore, Md.: Williams & Wilkins, 1998: 773-802). Thus, the modified FX polypeptides described herein can be used as part of a treatment regimen for some types of FMFD.

c. Others

Other congenital bleeding disorders can be treated with the FX polypeptides, including FX zymogen or FXa polypeptides, provided herein to promote coagulation. Spontaneous and surgery associated bleeding episodes associated with von Willebrand disease (vWD) can be treated using the modified FX polypeptides provided herein. vWD is a bleeding disorder caused by a defect or deficiency of the blood clotting protein, von Willebrand Factor (vWF), and is estimated to occur in 1% to 2% of the population. Subjects with vWD bruise easily, have recurrent nosebleeds, bleed after tooth extraction, tonsillectomy or other surgery, and women patients can have increased menstrual bleeding. Modified FX polypeptides can be used to ameliorate spontaneous and surgery-associated bleeding in vWD patients.

Other platelet-related bleeding disorders, such as for example, Glanzmann's thrombasthenia and Hermansky-Pudlak syndrome also are associated with reduced endogenous clotting activity. Excess spontaneous or surgery-associated bleeding in patients with platelet related bleeding disorders also can be controlled by therapeutic doses of the modified FX polypeptides. For example, a patient with Glanzmann's thrombasthenia undergoing surgery can be treated before, during and/or after surgery with the modified FX polypeptides to prevent major blood loss. The modified FX polypeptides can be administered as in the inactive zymogen form or as activated FX (FXa) polypeptides.

2. Acquired Bleeding Disorders

Bleeding disorders also can be acquired, rather than congenital. Modified FX zymogen and FXa polypeptides, such as those described herein, also can be used to treat acquired bleeding disorders. Acquired bleeding disorders include coagulopathy as a result of surgical procedures or drug-induced coagulopathy, for example thrombocytopenia due to chemotherapeutic regimens. In one example, modified FX polypeptides can be used as an antidote to an overdose of an anti-coagulant therapeutic (US 2011/0015128). Modified FX polypeptides also can be used to treat acquired coagulation factor deficiencies, such as acquired factor X deficiency as a result of liver disease, vitamin K deficiency. Other acquired bleeding disorders that can benefit from modified FX treatment include hemolytic-uremic syndrome, allergic purpura (Henoch Schonlein purpura) and disseminated intravascular coagulation (DIC).

In one example, the modified FX/FXa polypeptides can be used to treat bleeding episodes due to trauma, or surgery, or lowered count or activity of platelets, in a subject. For example, hemodilutional coagulopathy, for example as a result of blood transfusion, or acute traumatic coagulopathy following trauma can be treated with modified FX/FXa polypeptides. Exemplary methods for patients undergoing surgery include treatments to prevent hemorrhage and treatments before, during, or after surgeries such as, but not limited to, heart surgery, angioplasty, lung surgery, abdominal surgery, spinal surgery, brain surgery, vascular surgery, dental surgery, or organ transplant surgery, including transplantation of bone marrow, heart, lung, pancreas, or liver.

a. Chemotherapy-Acquired Thrombocytopenia

Chemotherapy treatment, such as for leukemia and other cancers, can result in thrombocytopenia. This is likely due to a loss of platelet production in the bone marrow of patients receiving chemotherapy, and typically occurs 6-10 days after medication. Treatment of the acquired thrombocytopenia is usually by platelet, red blood cell or plasma transfusion, which serves to prevent any abnormal spontaneous bleeding that can result from platelet deficiency. Bleeding in patients with chemotherapy-induced thrombocytopenia, or any other acquired or congenital thrombocytopenia, also can be controlled by administration of therapeutic amounts of the modified FX polypeptides provided herein. For example, a thrombocytopenic patient with uncontrolled bleeding, such as in the gastrointestinal tract, can be administered an intravenous bolus injection of a therapeutic amount of FX polypeptide to stop hemorrhaging. The modified FX polypeptides can be administered as in the inactive zymogen form or as activated FX (FXa) polypeptides.

b. Other Coagulopathies

Other acquired coagulopathies can be treated using the modified FX polypeptides presented herein. Coagulopathy can result from conditions including, but not limited to, fulminant hepatic failure (FHF; such as caused by hepatoxic drugs, toxins, metabolic diseases, infectious diseases and ischemia), other liver disease, including cirrhosis and disease associated with Wilson's disease, vitamin K deficiency (such as caused by antibiotic treatment or diet), hemolytic uremic syndrome, thrombotic thrombocytopenia (TTC) and disseminated intravascular coagulopathy (DIC). Conventional treatment is generally by transfusion with plasma, red blood cells (RBC), or platelets, but can be unsuccessful.

In one example, the modified FX polypeptides can be administered to a patient with FHF undergoing invasive procedures to prevent bleeding. Conventional treatment with fresh frozen plasma (FFP) often is unsuccessful and can require large quantities of plasma, producing volume overload and anasarca (a generalized infiltration of edema fluid into subcutaneous connective tissue). Treatment with therapeutic amounts of modified FX polypeptides by intravenous bolus during, before and/or after invasive surgery, such as for example, liver biopsy or liver transplantation, can prevent bleeding and establish hemostasis in FHF patients. The patient can be monitored by PT of the blood to determine the efficacy of treatment.

In another example, FX can be administered to a patient with severe bleeding associated with coagulopathy, such as for example, severe post-cesarean intra-abdominal bleeding associated with liver dysfunction and DIC, that did not respond to conventional transfusions infusions. Further, the modified FX polypeptides can be used to treat coagulopathy in neonatal and pediatric patients. The modified FX polypeptides provided herein exhibit enhanced FVa-dependency for increased coagulation activity compared with unmodified FX polypeptides and increased half-life, and can therefore be administered, for example, at lower doses, less frequently, and with fewer adverse reactions. The modified FX polypeptides can be administered as in the inactive zymogen form, to be activated by endogenous enzymes, or as activated FX (FXa) polypeptides.

c. Transplant-Acquired Bleeding

Severe bleeding following bone marrow transplant (BMT) and stem cell transplant (SCT) is a relatively common and life-threatening complication associated with these procedures, due to the reduction of platelets. For example, diffuse alveolar hemorrhage (DAH) is a pulmonary complication of BMT with an estimated incidence of 1-21% in the transplant population, and a mortality rate of 60-100%. Conventional treatment of such bleeding episodes includes corticosteroid treatment and transfusion with plasma, platelets and/or RBC, although these are largely unsuccessful with an overall mortality rate of approximately 50% (Hicks et al. (2002) *Bone Marrow Transpl.* 30:975-978). Administration of FX by intravenous bolus, with or without concurrent treatment with corticosteroids and/or platelet infusion, can be performed to treat DAH and establish hemostasis. The modified FX polypeptides provided herein exhibit enhanced FVa-dependency for increased coagulation activity compared with unmodified FX polypeptides and increased half-life, and can therefore be administered, for example, at lower doses, less frequently, and with fewer adverse reactions. The modified FX polypeptides can be administered as in the inactive zymogen form, to be activated by endogenous enzymes, or as activated FX (FXa) polypeptides.

d. Anticoagulant Therapy-Induced Bleeding

Patients undergoing anticoagulant therapies for the treatment of conditions, such as thromboembolism, can exhibit bleeding episodes upon acute administration of anticoagulants, such as warfarin, heparin, fondaparinux, and Rivaroxaban, or develop hemorrhagic disorders as a result long term usage of such therapies. Treatments for bleeding episodes typically include administration of procoagulants, such as vitamin K, plasma, exogenous FIX, and protamines to neutralize heparin. Administration of exogenous FX, alone or as a part of a pharmaceutical formulation, also can be performed to neutralize the effect of the anti-coagulants, increase PT, aPTT, and/or other markers of coagulation and establish hemostasis (Gruber et al., 2008 *Blood.* 112:Abstract 3825). The modified FX polypeptides provided herein can be used in treatments to control bleeding episodes in patients with acquired bleeding disorders due to anticoagulant treatments. The modified FX polypeptides can be administered as in the inactive zymogen form, to be activated by endogenous enzymes, or as activated FX (FXa) polypeptides. For more rapid treatment, modified polypeptides are generally administered as activated FX (FXa) polypeptides.

e. Acquired Hemophilia

Factor VIII inhibitors can develop spontaneously in otherwise healthy individuals, resulting in a condition known as "acquired hemophilia". Acquired hemophilia is a rare condition, with a yearly incidence of 0.2-1.0 per million population. The autoantibodies are mainly IgG4 antibodies, which, when bound to FVIII, inhibit FVIII activity by interfering with thrombin cleavage, von Willebrand factor interaction and/or phospholipid binding. This results in life-threatening hemorrhage in approximately 87% of affected patients. Common sites of bleeding are skin, mucosa, muscles and retroperitoneum, in contrast to patients with hereditary hemophilia who bleed predominantly in joints and muscles. Acquired hemophilia can be treated with an activated prothrombin complex concentrate or recombinant activated factor VII (NovoSeven®, Novo Nordisk) to control bleeding episodes. The modified FX polypeptides provided herein exhibit enhanced coagulation activity and bypass the need for FVII replacement therapy. The modified FX polypeptides can be administered as in the inactive zymogen form, to be activated by endogenous enzymes, or as activated FX (FXa) polypeptides. For applications requiring a more rapid resolution, for example during surgery, modified polypeptides can be administered as activated FX (FXa) polypeptides.

3. Trauma and Surgical Bleeding

Modified FX polypeptides can be used as therapy to treat bleeding associated with perioperative and traumatic blood loss in subjects with normal coagulation systems. For example, modified FX polypeptides can be administered to a patient to promote coagulation and reduce blood loss associated with surgery and, further, reduce the requirement for blood transfusion.

In some examples, modified FX polypeptides can be administered to patients with normal coagulation undergoing various types of surgery to effect rapid hemostasis and prevent blood loss. Treatment with modified FX can promote hemostasis at the site of surgery and reduce or prevent blood loss, thereby reducing or abolishing the need for transfusion. Some of the modified FX polypeptides provided herein exhibit enhanced properties such as increased half-life, increased resistance to circulating protease inhibitors, and increased catalytic activity, and might therefore be administered, for example, at lower doses, less frequently, and with fewer adverse reactions. The modified FX polypeptides can be administered as in the inactive zymogen form, to be activated by endogenous enzymes, or as activated FX (FXa) polypeptides.

Modified factor X polypeptides, such as those described herein, also can be used to promote coagulation and prevent blood loss in subjects with traumatic injury. Trauma is defined as an injury to living tissue by an extrinsic agent, and is the fourth leading cause of death in the United States. Trauma is classified as either blunt trauma (resulting in internal compression, organ damage and internal hemorrhage) or penetrative trauma (a consequence of an agent penetrating the body and destroying tissue, vessel and organs, resulting in external hemorrhaging). Trauma can be caused by several events including, but not limited to, vehicle accidents (causing blunt and/or penetrative trauma), gunshot wounds (causing penetrative trauma), stabbing wounds (causing penetrative trauma), machinery accidents (causing penetrative and/or blunt trauma), and falls from significant heights (causing penetrative and/or blunt trauma). Uncontrolled hemorrhage as a result of trauma is responsible for most of the associated mortality.

Diffuse coagulopathy is a relatively common complication associated with trauma patients, occurring in as many as 25-36% of subjects. Coagulopathy can develop early after injury, resulting from a variety of factors such as dilution and consumption of coagulation factors and platelets, fibrinolysis, acidosis, and hypothermia. Conventional management involves replacement therapy by transfusion with fresh frozen plasma (FFP) platelets, RBC and/or cryoprecipitate, correcting acidosis, and treating hypothermia. These steps often are insufficient to stop the bleeding and prevent death. Treatment by administration of therapeutic amounts of FX alone or in combination with other therapies can promote coagulation and reduce blood loss in trauma patients. For example, FX polypeptide-containing treatments enhanced coagulation and final clot strength in porcine models of dilutional coagulopathy (Dickneite et al., (2010) *J Trauma* 68(5):1151-1157; Mitterlechner et al., (2011) *J Thrombosis and Haemostasis.* 9(4): 729-737). The modified FX polypeptides provided herein exhibit enhanced FVa-dependency for increased coagulation activity compared with unmodified FX polypeptides and increased half-life, and can therefore be administered, for example, at lower doses, less frequently, and with fewer adverse reactions. The modified FX polypeptides can be administered as in the inactive zymogen form, to be activated by endogenous enzymes, or as activated FX (FXa) polypeptides.

I. Combination Therapies

Any of the modified FX polypeptides described herein can be administered in combination with, prior to, intermittently with, or subsequent to, other therapeutic agents or procedures including, but not limited to, other biologics, small molecule compounds and surgery. For any disease or condition, including all those exemplified above, for which FX (including FXa and rFXa) is indicated or has been used and for which other agents and treatments are available, FX, in zymogen or activated form, can be used in combination therewith. Hence, the modified FX polypeptides provided herein, in zymogen or activated form, similarly can be used. Depending on the disease or condition to be treated, exemplary combinations include, but are not limited to, combination with other plasma purified or recombinant coagulation factors, procoagulants, such as vitamin K, vitamin K derivative and protein C inhibitors, plasma, platelets, red blood cells and corticosteroids.

In some examples, blood and fresh frozen plasma (FFP) are sources of factor X replacement therapy for minimal elevation of Factor X levels (Girolami et al. (1970) *Thromb Diath Haemorrh* 24(1):175-184; Girolami et al., (1970) *Br J Haematol* 19(2):179-192). However, Factor X deficiency treatment is typically effected by treatment with prothrombinase complex concentrates (PCCs) that contain Factor X in addition to FII, FVII, and FIX (Lechler, E (1999) *Thromb Res* 95(Suppl 1):S39-S50). Such concentrates are commercially available, for example Konyne 80 (Cutter, USA); Profilnine HT (Alpha, USA); Proplex T (Baxter Hyland, USA; or Bebulin VH (Immuno, USA). Acivated PCCs are also available which contain activated FX (FXa), e.g., Autoplex (Baxter, Hyland, USA) and FEIBA (Immuno, USA). Typically, hemostasis is achieved with post-operative FX levels of 10-20 IU/dL (Knight et al., (1985) *Transfusion,* 25(1):78-80; Bolton-Maggs, PHB. The rare coagulation disorders. Treatment of hemophilia. Manchester: World Federation of Hemophilia; 2006). Concentrates of FIX and FX have also been used to treat Factor X deficiency. However, thromboembolic episodes are a concern when using PCCs, activated PCCs, and other concentrates containing unmodified FX polypeptides (Lechler (1999) *Thromb Res.* 95(Suppl. 1):S39-S50). Thromboembolic episodes FX- containing concentrates can be reduced or eliminated by using modified FX polypeptides, such as those described herein.

The modified FX polypeptides provided herein exhibit enhanced FVa-dependency for increased coagulation activity compared with unmodified FX polypeptides and increased half-life, and can therefore be administered, for example, at lower doses, less frequently, and with fewer adverse reactions. The modified FX polypeptides can be administered as in the inactive zymogen form, to be activated by endogenous enzymes, or as activated FX (FXa) polypeptides.

J. Articles of Manufacture and Kits

Pharmaceutical compounds of modified FX polypeptides or nucleic acids encoding modified FX polypeptides, or a derivative or a biologically active portion thereof can be packaged as articles of manufacture containing packaging material, a pharmaceutical composition which is effective for treating a hemostatic disease or disorder, and a label that indicates that modified FX polypeptide or nucleic acid molecule is to be used for treating hemostatic disease or disorder.

The articles of manufacture provided herein contain packaging materials. Packaging materials for use in packaging pharmaceutical products are well known to those of skill in the art. See, for example, U.S. Pat. Nos. 5,323,907 and 5,052,558, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any hemostatic disease or disorder.

Modified FX polypeptides and nucleic acid molecules also can be provided as kits. Kits can include a pharmaceutical composition described herein and an item for administration. For example a modified FX can be supplied with a device for administration, such as a syringe, an inhaler, a dosage cup, a dropper, or an applicator. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of FX or a FX regulated system of a subject.

K. EXAMPLES

The following examples are included for illustrative purposes only and are not intended to limit the scope of the invention.

Example 1

Cloning and Expression of Factor X Polypeptides

A. Cloning of Factor X Gene into pFUSE Vector

The nucleic acid encoding the 488 amino acid human Factor X (FX) precursor polypeptide (P00742; set forth in SEQ ID NO:1) was cloned into the mammalian expression vector, pFUSE-hIgG1-Fc2 (abbreviated herein as pFUSE) (InvivoGen; SEQ ID NO:266), which contains a composite promoter, hEF1-HTLV, containing the Elongation Factor-1α (EF-1α) core promoter and the R segment and part of the U5 sequence (R-U5') of the human T-Cell Leukemia Virus (HTLV) Type 1 Long Terminal Repeat. The In-Fusion CF Dry-Down PCR Cloning Kit (Clontech) was used according to the conditions specified by the supplier.

For the In-Fusion process, plasmid pFUSE without the human immunoglobulin 1 (hIgG1) Fc portion was linearized using polymerase chain reaction (PCR) with the pFUSE-Acc-F1 forward primer: GTGCTAGCTGGCCAGACATGATAAG (SEQ ID NO: 267) and the pFUSE-Acc-R3 reverse primer: CATGGTGGCCCTCCTTCGCCGGTGATC (SEQ ID NO: 268), and was used as Acceptor DNA. The full-length coding sequence of FX was amplified by PCR using human FX cDNA (Origene, Rockville, Md.) as template with the FX-wtsp-Invivo-F1 forward primer: CGAAGGAGGGC-CACCATGGGGCGCCCACTGCACCTC (SEQ ID NO: 269) and FX-Invivo-R1 reverse primer: TGTCTGGC-CAGCTAGCACTCACTTTAATGGAGAGGACG (SEQ ID NO: 270). For the two FX Donor amplification primer sequences set forth above, both FX 'ATG' start and complementary sequence of 'TGA' stop codons are underlined in the forward and reverse primer sequences, respectively. The 18-nt long homology regions, a non-annealing 5' primer tail for In-Fusion, are shown in bold.

Standard PCR reaction and thermocycling conditions were used in conjunction with the Phusion High-Fidelity Master Mix Kit (New England Biolabs), as recommended by the manufacturer. Both Acceptor and Donor PCR products were then digested with DpnI restriction enzyme to remove *E. coli*-derived dam methylated PCR template backgrounds. They were then mixed together, and the In-Fusion reaction was run using conditions specified by the supplier.

The reaction mix was transformed into *E. coli* XL1Blue supercompetent cells (Stratagene). Colonies were selected on 2xYT agar plates supplemented with 25 ppm Zeocin (InvivoGen). Plasmid DNA was isolated from selected clones, and sequenced to verify correct cloning. A clone containing the correct sequence was used for further studies.

B. Construction of FX Plasmid with Pro-Thrombin Signal- and Pro-Peptide Sequences To swap the FX native signal- and pro-peptide sequences with the pro-thrombin sequences, the plasmid generated in Example 1A above was linearized by PCR with the F10-Pro-Acc-F1 forward primer: GCCAATTCCTTTCTTGAA-GAGATG (SEQ ID NO: 271) and the pFUSE-Acc-R3 reverse primer: CATGGTGGCCCTCCTTCGCCGGTGATC (SEQ ID NO: 272), and was used as Acceptor DNA. The nucleotide sequences of the pro-thrombin signal- and pro-peptides (set forth as amino acids 1-43 SEQ ID NO:415 and set forth as SEQ ID NO:273) was amplified by PCR using human pro-thrombin cDNA (Origene) as template with the FII-SP+Pro-F10Acc-F1 forward primer: CGAAGGAGGGCCACC ATGGCGCACGTCCGAGGCTTG (SEQ ID NO: 274) and FII-SP+Pro-F10Acc-R1 reverse primer: TTCAAGAAAG-GAATTGGCTCGCCGGACCCGCTGGAGCAG (SEQ ID NO: 275). For the two pro-thrombin Donor amplification primer sequences set forth above, the 18-nt long homology regions, a non-annealing 5' primer tail for In-Fusion, are shown in bold, and the pro-thrombin 'ATG' start codon is underlined in the forward primer sequence. Standard PCR and InFusion reactions were performed as described above, and one sequence-verified clone, was chosen for use as a template for generation of FX variants.

C. Generation of FX Variants

FX variants were generated using the QuikChange Lightning Site-Directed Mutagenesis Kit (Stratagene) according to manufacturer's instructions with specifically designed oligonucleotides that served as primers to incorporate designed mutations into the newly synthesized DNA. Complementary primers that include the desired mutations were extended during cycling using the purified, double-stranded super-coiled plasmid DNA, generated in Example 1B, containing the cloned FX cDNA sequence as a template. Extension of the primers resulted in incorporation of the mutations of interest into the newly synthesized strands, and resulted in a mutated plasmid with staggered nicks. Following amplification, the mutagenesis product was digested with DpnI restriction enzyme to remove dam-methylated parental strands of the *E. coli*-derived plasmid DNA. The DNA was then transformed into *E. coli* XL1Blue supercompetent cells (Stratagene) followed by selection on 2xYT agar plates supplemented with 25 ppm Zeocin (InvivoGen). Plasmid DNA was isolated from selected clones, and sequenced to verify for incorporation of mutation(s) at the desired location(s) on the FX gene.

The nucleotide sequence of one of the oligonucleotides from each complementary primer pair used to generate the FX variants is provided in Table 15, below. The nucleotide triplet sequences that encode a substituted amino acid are shown in uppercase. For example, to generate a FX variant containing the substitution I16L (I16L by chymotrypsin numbering; SEQ ID NO:416), the FX-I16L-Forward primer, and a primer that is complementary to FX-I16L-Forward, were used to replace a 3-bp 'ATC' wild-type sequence with a 3-bp 'CTG' mutant sequence.

Table 15 below sets forth the oligonucleotide primers used for FX mutagenesis. The mutant triplets are shown in upper case, and primer names correspond to the mutation, by chymotrypsin numbering, produced as a result of the mutagenesis using the primer.

TABLE 15

| Primer Name (Chymotrypsin Numbering | Primer Sequence (5' to 3') | SEQ ID NO |
|---|---|---|
| FX-I16L-For | gacaacaacctcaccaggCTGgtgggaggccaggaatgc | 276 |
| FX-V17A-For | CaacaacctcaccaggatcGCCggaggccaggaatgcaag | 277 |
| FX-V17I-For | caacctcaccaggatcATCggaggccaggaatgc | 278 |
| FX-V17L-For | caacctcaccaggatcCTGggaggccaggaatgc | 279 |
| FX-V17T-For | caacctcaccaggatcACCggaggccaggaatgc | 280 |
| FX-V17S-For | caacctcaccaggatcAGCggaggccaggaatgc | 281 |
| FX-V17P-For | caacctcaccaggatcCCCggaggccaggaatgc | 282 |
| FX-G18A-For | accaggatcgtgGCCggccaggaatgcaaggac | 283 |
| FX-G18P-For | accaggatcgtgCCCggccaggaatgcaaggac | 284 |
| FX-G18S-For | accaggatcgtgAGCggccaggaatgcaaggac | 285 |
| FX-G18V-For | accaggatcgtgGTGggccaggaatgcaaggac | 286 |
| FX-G18T-For | accaggatcgtgACCggccaggaatgcaaggac | 287 |
| FX-G19A-For | caccaggatcgtgggaGCCcaggaatgcaaggac | 288 |
| FX-G19V-For | caccaggatcgtgggaGTGcaggaatgcaaggac | 289 |
| FX-G19R-For | caccaggatcgtgggaCGGcaggaatgcaaggac | 290 |
| FX-G19K-For | caccaggatcgtgggaAAGcaggaatgcaaggac | 291 |
| FX-G19P-For | caccaggatcgtgggaCCCcaggaatgcaaggac | 292 |
| FX-G19H-For | caccaggatcgtgggaCACcaggaatgcaaggac | 293 |
| FX-D194N-For | gatgcctgccaggggAACagcgggggcccgcac | 294 |
| FX-D194S-For | gatgcctgccaggggAGCagcgggggcccgcac | 295 |

TABLE 15-continued

TABLE 15: Oligonucleotide Primers

| Primer Name (Chymotrypsin Numbering | Primer Sequence (5' to 3') | SEQ ID NO |
|---|---|---|
| FX-L32S/G40H-For | gtgtccctggcaggccAGCctcatcaatgaggaaaacgagCACttct gtggtggaacc | 296 |
| FX-E21A-For | gatcgtgggaggccagGCCtgcaaggacggggag | 297 |
| FX-E21S-For | gatcgtgggaggccagAGCtgcaaggacggggag | 298 |
| FX-E21V-For | gatcgtgggaggccagGTGtgcaaggacggggag | 299 |
| FX-K23S-For | ggaggccaggaatgcAGCgacggggagtgtccc | 300 |
| FX-R143A-For | gtgagcggcttcgggGCCacccacgagaagggc | 301 |
| FX-R143S-For | gtgagcggcttcgggAGCacccacgagaagggc | 302 |
| FX-R143T-For | gtgagcggcttcgggACCacccacgagaagggc | 303 |
| FX-R143V-For | gtgagcggcttcgggGTGacccacgagaagggc | 304 |
| FX-R143Q-For | gtgagcggcttcgggCAGacccacgagaagggc | 305 |
| FX-R143N-For | gtgagcggcttcgggAACacccacgagaagggc | 306 |
| FX-R143M-For | gtgagcggcttcgggATGacccacgagaagggc | 307 |
| FX-R143K-For | gtgagcggcttcgggAAGacccacgagaagggc | 308 |
| FX-R143Y-For | gtgagcggcttcgggTACacccacgagaagggc | 309 |
| FX-R143D-For | gtgagcggcttcgggGACacccacgagaagggc | 310 |
| FX-T144A-For | gagcggcttcgggcgcGCCacgagaagggccgg | 311 |
| FX-T144L-For | gagcggcttcgggcgcCTGacgagaagggccgg | 312 |
| FX-S152A-For | gagaagggccggcagGCCaccaggctcaagatg | 313 |
| FX-S152T-For | gagaagggccggcagACCaccaggctcaagatg | 314 |
| FX-S152N-For | gagaagggccggcagAACaccaggctcaagatg | 315 |
| FX-R154E-For | ggccggcagtccaccGAGctcaagatgctggag | 316 |
| FX-K156A-For | cagtccaccaggctcGCCatgctggaggtgccc | 317 |
| FX-K156S-For | cagtccaccaggctcAGCatgctggaggtgccc | 318 |
| FX-K156N-For | cagtccaccaggctcAACatgctggaggtgccc | 319 |
| FX-K156D-For | cagtccaccaggctcGACatgctggaggtgccc | 320 |
| FX-K156R-For | cagtccaccaggctcAGGatgctggaggtgccc | 321 |
| FX-K156V-For | cagtccaccaggctcGTGatgctggaggtgccc | 322 |
| FX-K156Y-For | cagtccaccaggctcTACatgctggaggtgccc | 323 |
| FX-K156M-For | cagtccaccaggctcATGatgctggaggtgccc | 324 |
| FX-V17S/G18A-For | caacctcaccaggatcAGCGCCggccaggaatgcaag | 325 |
| FX-I16L/V17S-For | gacaacaacctcaccaggCTGAGCggaggccaggaatgcaag | 326 |
| FX-I16L/G18A-For | gacaacaacctcaccaggCTGgtgGCCggccaggaatgcaaggac | 327 |
| FX-S152A/K156M-For | gagaagggccggcagGCCaccaggctcATGatgctggaggtgccc | 328 |
| FX-N35D-For | ccctggcaggccctgctcatcGACgaggaaaacgagggtttctgt | 329 |
| FX-N35A-For | ccctggcaggccctgctcatcGCCgaggaaaacgagggtttctgt | 330 |
| FX-N35S-For | ccctggcaggccctgctcatcAGCgaggaaaacgagggtttctgt | 331 |
| FX-E37R-For | caggccctgctcatcaatgagCGCaacgagggtttctgtggtgga | 332 |

TABLE 15-continued

TABLE 15: Oligonucleotide Primers

| Primer Name (Chymotrypsin Numbering | Primer Sequence (5' to 3') | SEQ ID NO |
|---|---|---|
| FX-E37K-For | caggccctgctcatcaatgagAAGaacgagggtttctgtggtgga | 333 |
| FX-E37A-For | caggccctgctcatcaatgagGCCaacgagggtttctgtggtgga | 334 |
| FX-E37S-For | caggccctgctcatcaatgagAGCaacgagggtttctgtggtgga | 335 |
| FX-E39R-For | ctgctcatcaatgaggaaaacCGCggtttctgtggtggaactatt | 336 |
| FX-E39K-For | ctgctcatcaatgaggaaaacAAGggtttctgtggtggaactatt | 337 |
| FX-E39A-For | ctgctcatcaatgaggaaaacGCCggtttctgtggtggaactatt | 338 |
| FX-R150A-For | gggcgcacccacgagaagggcGCCcagtccaccaggctcaagatg | 339 |
| FX-R150D-For | gggcgcacccacgagaagggcGACcagtccaccaggctcaagatg | 340 |
| FX-R150E-For | gggcgcacccacgagaagggcGAGcagtccaccaggctcaagatg | 341 |
| FX-R150S-For | gggcgcacccacgagaagggcAGCcagtccaccaggctcaagatg | 342 |
| FX-R150G-For | gggcgcacccacgagaagggcGGCcagtccaccaggctcaagatg | 343 |
| FX-R143E-For | gggattgtgagcggcttcgggGAGacccacgagaagggccggcag | 344 |
| FX-R143D-For | gggattgtgagcggcttcgggGACcccacgagaagggccggcag | 345 |
| FX-R143M-For | gggattgtgagcggcttcgggATGacccacgagaagggccggcag | 346 |
| FX-R143N-For | gggattgtgagcggcttcgggAACcccacgagaagggccggcag | 347 |
| FX-R143Q-For | gggattgtgagcggcttcgggCAGacccacgagaagggccggcag | 348 |
| FX-R93E-For | gaggtggtcatcaagcacaacGAGttcacaaaggagacctatgac | 349 |
| FX-R93A-For | gaggtggtcatcaagcacaacGCCttcacaaaggagacctatgac | 350 |
| FX-R240A-For | gccttcctcaagtggatcgacGCCtccatgaaaaccaggggcttg | 351 |
| FX-R240E-For | gccttcctcaagtggatcgacGAGtccatgaaaaccaggggcttg | 352 |
| FX-K236A-For | accaaggtcaccgccttcctcGCCtggatcgacaggtccatgaaa | 353 |
| FX-K236E-For | accaaggtcaccgccttcctcGAGtggatcgacaggtccatgaaa | 354 |
| FX-R125A-For | gcgcctgcctgcctccccgagGCCgactgggccgagtccacgctg | 355 |
| FX-R125E-For | gcgcctgcctgcctccccgagGAGgactgggccgagtccacgctg | 356 |
| FX-K96A-For | atcaagcacaaccggttcacaGCCgagacctatgacttcgacatc | 357 |
| FX-K96E-For | atcaagcacaaccggttcacaGAGgagacctatgacttcgacatc | 358 |
| FX-K236E/R240E-For | gtcaccgccttcctcGAGtggatcgacGAGtccatgaaaaccagg | 359 |
| FX-K156A-For | ggccggcagtccaccaggctcGCCatgctggaggtgccctacgtg | 360 |
| FX-K156S-For | ggccggcagtccaccaggctcAGCatgctggaggtgccctacgtg | 361 |
| FX-E[51]N-For | gatggcgaccagtgtAACaccagtccttgccag | 362 |
| FX-Q[56]N/Q[58]S-For | gagaccagtccttgccAACaacAGCggcaaatgtaaagac | 363 |
| FX-Q[58]N/K[60]S-For | cagtccttgccagaacAACggcAGCtgtaaagacggcctc | 364 |
| FX-K[62]N/G[64]S-For | gaaccagggcaaatgtAACgacAGCctcggggaatacacc | 365 |
| FX-L[65]N/E[67]S-For | caaatgtaaagacggcAACgggAGCtacacctgcacctg | 366 |
| FX-E[67]N-For | gtaaagacggcctcgggAACtacacctgcacctgtttag | 367 |
| FX-L[73]N/G[75]S-For | gaatacacctgcacctgtAACgaaAGCttcgaaggcaaaaac | 368 |
| FX-G[75]N/E[77]S-For | ctgcacctgtttagaaAACttcAGCggcaaaaactgtgaattattc | 369 |

TABLE 15-continued

TABLE 15: Oligonucleotide Primers

| Primer Name (Chymotrypsin Numbering | Primer Sequence (5' to 3') | SEQ ID NO |
|---|---|---|
| FX-R[86]N/L[88]S-For | ctgtgaattattcacaAACaagAGCtgcagcctggacaac | 370 |
| FX-T[85]N/K[87]S-For | caaaaactgtgaattattcAACcggAGCctctgcagcctggac | 371 |
| FX-L[83]N-For | ggcaaaaactgtgaaAACttcacacggaagctc | 372 |
| FX-E[82]N/F[84]S-For | gaaggcaaaaactgtAACttaAGCacacggaagctctgc | 373 |
| FX-E[82]S-For | gaaggcaaaaactgtAGCttattcacacggaag | 374 |
| FX-G[78]N/N[80]S-For | gtttagaaggattcgaaAACaaaAGCtgtgaattattcacac | 375 |
| FX-E[77]N/K[79]S-For | ctgtttagaaggattcAACggcAGCaactgtgaattattc | 376 |
| FX-D[95]N/D[97]S-For | cagcctggacaacgggAACtgtAGCcagttctgccacgag | 377 |
| FX-G[114]N-For | gtgctcctgcgcccgcAACtacaccctggctgac | 378 |
| FX-K[122]S-For | ctggctgacaacggcAGCgcctgcattccacag | 379 |
| FX-D[119]N/G[121]S-For | gggtacaccctggctAACaacAGCaaggcctgcattccc | 380 |
| FX-K23N/G25S-For | ggaggccaggaatgcAACgacAGCgagtgtccctggcag | 381 |
| FX-E36N/N38S-For | gccctgctcatcaatAACgaaAGCgagggtttctgtggtg | 382 |
| FX-R63N/K65S-For | ctctaccaagccaagAACttcAGCgtgagggtaggggac | 383 |
| FX-E84N/E86S-For | ggtgaggcggtgcacAACgtgAGCgtggtcatcaagcac | 384 |
| FX-T113N/R115S-For | ctcaagaccccatcAACttcAGCatgaacgtggcgcctg | 385 |
| FX-K134N/G136S-For | acgctgatgacgcagAACacgAGCattgtgagcggcttc | 386 |
| FX-R202N/K204S-For | ggcccgcacgtcaccAACttcAGCgacacctacttcgtg | 387 |
| FX-D205N/Y207S-For | gtcacccgcttcaagAACaccAGCttcgtgacaggcatc | 388 |
| FX-K204N-For | cacgtcacccgcttcAACgacacctacttcgtg | 389 |
| FX-T244N/G246S-For | gacaggtccatgaaaAACaggAGCttgcccaaggccaag | 390 |
| FX-R245N/L247S-For | aggtccatgaaaaccAACggcAGCcccaaggccaagagc | 391 |
| FX-G[114]N + D[119]N/ G[121] S-For | gtgctcctgcgcccgcAACtacaccctggctAACaacAGCaaggcctgcattccc | 392 |

Table 16 below sets forth the FX variants that were generated, with the mutations indicated using numbering relative to the mature FX polypeptide set forth in SEQ ID NO:134, and also based on chymotrypsin numbering. The provided SEQ ID NOS refer to the encoded precursor polypeptide and mature sequences of the listed mutants.

TABLE 16

FX Variants

| Mutation (Mature FX Numbering) | Mutation (Chymotrypsin Numbering) | SEQ ID NO. (precursor) | SEQ ID NO. (mature) |
|---|---|---|---|
| I195L | I16L | 416 | 135 |
| V196I | V17I | 417 | 136 |
| V196S | V17S | 418 | 137 |
| T85N/K87S/V196S | T[85]N/K[87]S/V17S | 419 | 138 |
| Q56N/Q58S/V196S | Q[56]N/Q[58]S/V17S | 420 | 139 |
| K62N/G64S/V196S | K[62]N/G[64]S/V17S | 421 | 140 |
| L65N/E67S/V196S | L[65]N/E[67]S/V17S | 422 | 141 |
| E67N/V196S | E[67]N/V17S | 423 | 142 |
| L73N/G75S/V196S | L[73]N/G[75]S/V17S | 424 | 143 |
| G75N/E77S/V196S | G[75]N/E[77]S/V17S | 425 | 144 |

TABLE 16-continued

FX Variants

| Mutation (Mature FX Numbering) | Mutation (Chymotrypsin Numbering) | SEQ ID NO. (precursor) | SEQ ID NO. (mature) |
|---|---|---|---|
| R86N/L88S/V196S | R[86]N/L[88]S/V17S | 426 | 145 |
| G114N/V196S | G[114]N/V17S | 427 | 146 |
| D95N/D97S/V196S | D[95]N/D[97]S/V17S | 428 | 147 |
| E82S/V196S | E[82]S/V17S | 429 | 148 |
| E82N/F84S/V196S | E[82]N/F[84]S/V17S | 430 | 149 |
| G78N/N80S/V196S | G[78]N/N[80]S/V17S | 431 | 150 |
| E77N/K79S/V196S | E[77]N/K[79]S/V17S | 432 | 151 |
| D119N/G121S/V196S | D[119]N/G[121]S/V17S | 433 | 152 |
| L83N/V196S | L[83]N/V17S | 434 | 153 |
| K122S/V196S | K[122]S/V17S | 435 | 154 |
| E51N/V196S | E[51]N/V17S | 436 | 155 |
| Q58N/K60S/V196S | Q[58]N/K[60]S/V17S | 437 | 156 |
| G114N/D119N/G121S/V196S | G[114]N/D[119]N/G[121]S/V17S | 438 | 157 |
| G198A | G19A | 439 | 158 |
| G198V | G19V | 440 | 159 |
| G198R | G19R | 441 | 160 |
| G198K | G19K | 442 | 161 |
| G198P | G19P | 443 | 162 |
| G198H | G19H | 444 | 163 |
| L211S/G219H | L32S/G40H | 445 | 164 |
| G197P | G18P | 446 | 165 |
| D378N | D194N | 447 | 166 |
| D378S | D194S | 448 | 167 |
| V196L | V17L | 449 | 168 |
| V196T | V17T | 450 | 169 |
| V196P | V17P | 451 | 170 |
| G197V | G18V | 452 | 171 |
| G197T | G18T | 453 | 172 |
| G197S | G18S | 454 | 173 |
| E200A | E21A | 455 | 174 |
| E200S | E21S | 456 | 175 |
| E200V | E21V | 457 | 176 |
| K202S | K23S | 458 | 177 |
| R326A | R143A | 459 | 178 |
| R326S | R143S | 460 | 179 |
| R326T | R143T | 461 | 180 |
| R326V | R143V | 462 | 181 |
| R326Q | R143Q | 463 | 182 |
| R326N | R143N | 464 | 183 |
| R326M | R143M | 465 | 184 |
| R326K | R143K | 466 | 185 |
| R326Y | R143Y | 467 | 186 |
| T327A | T144A | 468 | 187 |
| T327L | T144L | 469 | 188 |
| S334A | S152A | 470 | 189 |
| S334T | S152T | 471 | 190 |
| S334N | S152N | 472 | 191 |
| R336E | R154E | 473 | 192 |
| K338A | K156A | 474 | 193 |
| K338S | K156S | 475 | 194 |
| K338N | K156N | 476 | 195 |
| K338R | K156R | 477 | 196 |
| K338V | K156V | 478 | 197 |
| K338Y | K156Y | 479 | 198 |
| K338M | K156M | 480 | 199 |
| T327A/K338A | T144A/K156A | 481 | 200 |
| T327L/K338M | T144L/K156M | 482 | 201 |
| E200V/T327L/K338M | E21V/T144L/K156M | 483 | 202 |
| E200V/T327L/S334A/K338M | E21V/T144L/S152A/K156M | 484 | 203 |
| V196S/G197A | V17S/G18A | 485 | 204 |
| V196S/L211S/G219H | V17S/L32S/G40H | 486 | 205 |
| D119N/G121S/V196S/L211S/G219H | D[119]N/G[121]S/V17S/L32S/G40H | 487 | 206 |
| G114N/V196S/L211S/G219H | G[114]N/V17S/L32S/G40H | 488 | 207 |
| G114N/D119N/G121S/V196S/ L211S/G219H | G[114]N/D[119]N/G[121]S/V17S/L32S/ G40H | 489 | 208 |
| G197A/L211S/G219H | G18A/L32S/G40H | 490 | 209 |
| V196S/G197A/L211S/G219H | V17S/G18A/L32S/G40H | 491 | 210 |
| I195L/V196S | I16L/V17S | 492 | 211 |
| I195L/G197A | I16L/G18A | 493 | 212 |
| I195L/L211S/G219H | I16L/L32S/G40H | 494 | 213 |
| V196S/N214D | V17S/N35D | 495 | 214 |
| V196S/N214A | V17S/N35A | 496 | 215 |
| V196S/N214S | V17S/N35S | 497 | 216 |
| V196S/E216R | V17S/E37R | 498 | 217 |

TABLE 16-continued

FX Variants

| Mutation (Mature FX Numbering) | Mutation (Chymotrypsin Numbering) | SEQ ID NO. (precursor) | SEQ ID NO. (mature) |
|---|---|---|---|
| V196S/E216K | V17S/E37K | 499 | 218 |
| V196S/E216A | V17S/E37A | 500 | 219 |
| V196S/E216S | V17S/E37S | 501 | 220 |
| V196S/E218R | V17S/E39R | 502 | 221 |
| V196S/E218K | V17S/E39K | 503 | 222 |
| V196S/E218A | V17S/E39A | 504 | 223 |
| V196S/R332A | V17S/R150A | 505 | 224 |
| V196S/R332D | V17S/R150D | 506 | 225 |
| V196S/R332E | V17S/R150E | 507 | 226 |
| V196S/R332S | V17S/R150S | 508 | 227 |
| V196S/R332G | V17S/R150G | 509 | 228 |
| V196S/R326E | V17S/R143E | 510 | 229 |
| V196S/R326D | V17S/R143D | 511 | 230 |
| V196S/R326M | V17S/R143M | 512 | 231 |
| V196S/R326N | V17S/R143N | 513 | 232 |
| V196S/R326Q | V17S/R143Q | 514 | 233 |
| V196S/R273E | V17S/R93E | 515 | 234 |
| V196S/R273A | V17S/R93A | 516 | 235 |
| V196S/R424A | V17S/R240A | 517 | 236 |
| V196S/R424E | V17S/R240E | 518 | 237 |
| V196S/K420A | V17S/K236A | 519 | 238 |
| V196S/K420E | V17S/K236E | 520 | 239 |
| V196S/R306E | V17S/R125A | 521 | 240 |
| V196S/K276A | V17S/K96A | 522 | 241 |
| V196S/K276E | V17S/K96E | 523 | 242 |
| V196S/K420E/R424E | V17S/K236E/R240E | 524 | 243 |
| V196S/R273E/K420E/R424E | V17S/R93E/K236E/R240E | 525 | 244 |
| V196S/R273E/R306E/K420E/R424E | V17S/R93E/R125E/K236E/R240E | 526 | 245 |

Example 2

Expression, Purification, and Activation of FX Polypeptides

A. Expression and Purification of FX Polypeptides

Wild-type and variant FX polypeptides were expressed in CHO-Express (CHOX) cells (Excellgene). CHO Express (CHOX) cells were maintained in DM204B Complete medium (Irvine Scientific) and used to inoculate production seed cultures. Transfections were performed in WAVE bioreactors (GE Healthcare). 20 L wave bags were inoculated with approximately 400 mL of seed culture with 4.6 L of DM204B Complete media to a seeding density of $1.2 \times 10^6$ vc/mL. The WAVE bioreactor was set to a rocking angle of 6 degrees and a rocking rate of 24 rpm at 37.1° C. in order to allow the cells to reach a cell density of $13\text{-}16 \times 10^6$ vc/mL 3 days later. 16 mg of FX plasmid DNA and 102.5 mg of PEI (polyethyleneimine) were combined to form a transfection complex, which was diluted in 5.0 L of TfMAX2 prior to addition to the culture on the WAVE bioreactor, 3 days after the initial seeding. The Transfection complex plus TfMAX media was added to the wave bag. The culture was allowed to express for 4 days before harvesting the crude FX lysates. For harvesting, the contents of the wave bags were allowed to settle for 3 hrs at 4° C. The culture supernatant was then harvested through a CUNO depth filter, followed by FX purification.

FX polypeptides were purified using a Q Fast Flow column (GE Healthcare), to which FX polypeptides with functional Gla domains will adsorb, followed by a calcium elution step. Typically, culture supernatant from the transfected cells was diluted 2-fold with a solution containing 20 mM Tris pH 8.0, and then 500 mM EDTA pH 8.0 was added to the diluted sample to a final EDTA concentration of 1.5 mM. The samples were filtered before they were loaded onto the Q Fast Flow column which had been pre-equilibrated first with Buffer B (20 mM Tris pH 8.0, 1 M NaCl), then Buffer A (20 mM Tris pH 8.0, 0.15 M NaCl). After the samples were loaded, the column was washed with Buffer A until the absorbance of the flow-through at 280 nm reached a baseline. Buffer A was replaced with Buffer C (20 mM Tris pH 8.0, 0.15 M NaCl, 10 mM $CaCl_2$) and a pump wash was performed to completely replace the buffer in the lines. Upon completion of the pump wash, Buffer C was applied to the column to elute the FX polypeptides, which were collected in fractions. Following elution, the column was washed with Buffer B while still collecting fractions, until the pink pigment (from the culture media) was washed off the column. The column was re-equilibrated for re-use by washing with Buffer A.

The eluted fractions were further purified using a Source 15Q column (GE Healthcare). The fractions collected with buffer C above, which contained FX were pooled and EDTA was added to a final concentration of 20 mM. The pooled fractions were then diluted 2-fold with 50 mM Tris, pH 8.0 and loaded onto a Source 15Q column which had been pre-equilibrated with Buffer D (20 mM Tris pH 8.0, 0.15 M NaCl, 0.01% Tween 20, 2.5 mM $CaCl_2$). After washing the loaded column with Buffer D, a gradient of 0.15M NaCl to 0.5M NaCl was applied to the column and fractions were collected. Fractions containing FX were pooled and $CaCl_2$ was added to 12.5 mM.

B. Activation of FX and FX Variants

To generate activated FX (FXa) from the FX zymogen, 10.1 µg per mL of Russell's Viper Venom FX Activator (Haematologic Technologies) which had been previously conjugated with biotin were added to the pooled fractions containing, generated in Example 2A. The activation reaction was incubated at 37° C. for 1.5 hours, then diluted 1:5 in 20 mM MES, pH 6.0. The mixture was then applied to a StrepTrap column (GE Healthcare) to remove the Russell's Viper Venom FX Activator.

Finally, the unactivated FX was separated from the activated FXa by Heparin HP chromatography. The column flow-through from the StrepTrap column was applied directly to a Heparin HP column (GE Healthcare), which had been previously equilibrated in Buffer E (20 mM MES, pH 6.0, 50 mM NaCl). A linear gradient from 0.1 to 0.7 M NaCl in 20 mM MES, pH 6.0 was applied to the column and fractions were collected. Fractions containing active FXa were pooled and buffer exchanged—into 5 mM MES, pH 6.0, 100 mM NaCl by diafiltration.

Example 3

Determination of the Catalytically Active Protease (FXa) Concentration in a Stock Solution Determination of the catalytically active concentration of Factor Xa (FXa) in a stock solution of FXa, or FXa variant, was performed by titration of the stock protease sample with fluorescein-mono-p'-guanidinobenzoate (FMGB), a fluorogenic ester substrate developed as an active site titrant for trypsin-like serine proteases. In some instances, the concentration of active FXa or FXa variant also was determined by titration with ecotin, a natural tight-binding reversible inhibitor of FXa from *Escherichia coli* having a picomolar IC; against wild-type FXa (Seymour et al. (1994) *Biochemistry* 33:3949-3958). For a subset of FXa variants where FMGB titration was not possible, ecotin titration was effected as described below.

A. Active Site Titration of FXa using the Active Site Titrant Fluorescein-mono-p'-Guanidinobenzoate (FMGB).

The concentration of catalytically active Factor X (FXa) in a stock solution of FXa was determined by a modified version of the titration assay described by Bock et al. (*Archives of Biochemistry and Biophysics* (1989) 273:375-388) using the fluorogenic ester substrate fluorescein-mono-p'-guanidinobenzoate (FMGB). FMGB readily reacts with FXa, but not FX or inactive protease, to form an effectively stable acyl-enzyme intermediate under conditions in which the concentration of FMGB is saturating and deacylation is especially slow and rate limiting for catalysis. Under these conditions, the FXa protease undergoes a single catalytic turnover to release the fluorescein fluorophore. When the initial burst of fluorescence is calibrated to an external concentration standard curve of fluorescein fluorescence, the concentration of active sites can be calculated.

Modifications to the assay as originally described by Bock et al. were: 1) the inclusion of saturating amounts of the cofactor to FXa, 2) the addition of Factor Va (plasma purified FVa, Heamatologic Technologies) and a high concentration of phospholipids (75% phosphatidylcholine (PC)/25% phosphatidylserine (PS); PC/PS vesicles ~120 nm in diameter; Avanti Polar Lipids) and 3) an increased concentration of FMGB.

In the absence of FVa and PC/PS vesicles, FXa variants with demonstrated increased cofactor dependence reacted poorly, or did not react with the FMGB ester substrate. Therefore, these modifications were required to support the full catalytic activity of FXa variants, in which a high degree of cofactor dependence was engineered (see example 4A).

Further revisions were developed to modify the assay for a 96-well plate format to minimize reaction volumes and increase sample throughput (up to 18 samples per plate). The active site titration assays were performed with a final 50 µL reaction volume in a 96-well black half-area plate (Costar #3694). The current method was optimized for active site titration of FXa protease variants with stock solutions ranging from 10-100 µM. For protease stocks with estimated concentrations outside this range, a concentration or initial dilution step was necessary. Final reactions contained ~300-650 nM of each FXa variant and 10, 50 or 75 µM FMGB in 1× Buffer A (50 mM Hepes-NaOH, 50 mM NaCl, 5 mM $CaCl_2$ and 0.1% BSA, pH 7.4) containing 1 µM FVa and 240 µM PC/PS phospholipids. Working solutions of FMGB were prepared at a 2× concentration in Buffer A (20-150 µM) from a stock concentration of 5 mM FMGB in DMF based on the dry weight and the concentration was confirmed by absorbance spectroscopy at 452 nm using an extinction coefficient of 19,498 $M^{-1}$ $cm^{-1}$ in Phosphate Buffered Saline (PBS), pH 7.2.

Active site titration assays were prepared as follows: FXa variants were diluted to 0.6-1.3 µM in 1× Buffer A containing 2×FVa and PC/PS vesicles (2 µM and 480 µM, respectively) and a volume of 25 µL was aliquoted in duplicate wells of a 96-well black half-area assay plate. Reactions were initiated by the addition of 25 µL of the 2× working solution of FMGB (20-150 µM) in 1× Buffer A. The release of fluorescein fluorescence in the burst phase of the reaction was measured every 30 seconds, for 180 minutes, using an Envision microplate reader (Perkin Elmer) with an excitation of 485 nm and an emission of 535 nm.

The stoichiometric amount of fluorescein released following catalysis of FMGB by active FXa was determined using a standard curve of free fluorescein in 1× Buffer A containing 1 µM FVa and 240 µM PC/PS phospholipids. The fluorescein standard solution was freshly prepared from a stock solution of ~70-150 mM in DMF, with the accurate concentration of FMGB confirmed by absorbance spectroscopy under standard conditions at 496 nm using an extinction coefficient of 89,125 $M^{-1}$ $cm^{-1}$ in 0.1 N NaOH. A standard curve of free fluorescein was then prepared by serial dilution of the standard into 1× Buffer A containing 1 µM FVa and 240 µM PC/PS phospholipids with a range of 0 to 2.5 µM FMGB.

For data analysis, reaction traces were exported as .TXT files from the Envision software package (Perkin Elmer) and subsequent non-linear data analyses were performed with XLfit4, a software package for automated curve fitting and statistical analysis within the Microsoft Excel spreadsheet environment (IDBS Software). Contribution of background FMGB hydrolysis was determined and subtracted from the experimental reaction trace using a set of control wells in which no FXa was added. Typically background FMGB hydrolysis was less than 5% of the total observed fluorescence burst. The corrected curve was fit to a single exponential equation with a linear component (to account for the slow rate of deacylation) of the form: $\Delta Fluorescence = Y_0 + Amp*(1-\exp(-k_{obs}*(X-X_0))) + slope*(X-X_0)$ where parameters X and $X_0$=the time of completion and the time of reaction initiation, $Y_0$=an offset that accounts for background fluorescence in the assay system, Amp=the amplitude of the burst phase under the saturating assay conditions outline above, $k_{obs}$ is the observed first order rate constant for acyl-enzyme formation and slope is a bulk rate constant associated with complete turnover of FMGB by the protease. The concentration of active FXa protease in the reaction was calculated by comparison of the fit parameter for amplitude (Amp) to the fluorescein standard curve. The values from duplicate assays were averaged and the standard deviation determined. The concentration of active FXa in the stock preparation was then determined from the calculated assay concentration and adjusted for the degree of dilution used in the assay.

B. Active Site Titration of FXa using a Tight-Binding Inhibitor

When FMGB titration was not possible, the concentration of catalytically active Factor Xa or FXa variant in a stock solution of FXa was determined by titration with a known amount of ecotin, a tight-binding reversible inhibitor of FXa from *Escherichia coli*.

The concentration of active ecotin in the commercially available preparation (Molecular Innovations, Inc.) was determined by titrating a known concentration of recombinant human trypsin (rh-Trypsin, Polymun Scientific) with the commercial *E. coli* ecotin preparation. Titrations were performed in a 2.0 mL volume of 1× Buffer B (20 mM Hepes, 150 mM NaCl, 5 mM $CaCl_2$, 0.1% PEG 8000) using a final concentration of 100 nM active site titrated rh-Tyrpsin and a stepped dose of ecotin from 0-200 nM. Following 60 min incubations at room temperature in a 96-well deep-well polypropylene plate, 2.0 mL were transferred to a clean quartz cuvette (10 mm×10 mm). FMGB was added to a final concentration of 5 μM (1.9 μL/2.0 mL from a 5.3 mM stock) and the residual active rh-Trypsin was determined from the FMGB burst. Data were integrated over 50 seconds of the burst plateau for each dose of ecotin and transformed into $\Delta F_{obs}/\Delta F_{max}$, where $\Delta F_{max}$ is the total amplitude of the rh-Trypsin burst in the absence of inhibitor and $\Delta F_{obs}$ is the amplitude of the burst in the presence of inhibitor. The working concentration of active inhibitor was subsequently determined from the extrapolated X-intercept at complete inhibition and the known amount of active rh-Trypsin in the reaction.

Ecotin active site titration reactions were performed by preparing a 1.33-fold dilution series (150 μL into 50 μl) of ecotin at a 2× concentration (400 nM-0 nM) in 1× Buffer B supplemented with 0.1% BSA. FXa or FXa variant protease samples were diluted to a 2× working concentration (400 nM) and 50 μL were aliquoted into duplicate wells of a 96-well polypropylene assay plate. Reactions were initiated by the addition of 50 μL of the 2× ecotin 12-point dilution series to final concentrations of ecotin ranging from 200 nM-0 nM in reaction volumes of 100 μL (50 μL+50 μL).

Inhibition reactions were incubated for 120 minutes at room temperature (~25° C.) prior to reading out the residual activity of FXa or FXa variant with the fluorogenic substrate, Pefafluor Xa ($CH_3SO_2$-D-CHA-Gly-Arg-AMC, Centerchem). Wild-type FXa and FXa variants with high activity on the peptide substrate were diluted 10 to 100-fold into a final 75 μL volume of 1× Buffer B supplemented with 0.1% BSA buffer to achieve a reaction rate in an acceptable range. FXa variants with poor activity on the peptide substrate were tested undiluted. The 75 μL of diluted or undiluted samples were transferred to a 96-well black assay plate, followed by the addition of 25 μL of 0.4 mM (0.1 mM final) Pefafluor Xa. The initial velocity of the reaction was then measured at 25° C. for 15-60 min. It was assumed that any dissociation due to dilution changes was negligible during the velocity measurement; thus, incubation concentrations were the final concentrations used for inhibitor and protease in the following data analyses.

The ratio of the reaction velocity in the presence of inhibitor ($V_i$) to the reaction velocity in the absence of inhibitor ($V_0$) was determined for each concentration of the inhibitor (ecotin) at a fixed concentration of protease. The $V_i/V_0$ ratios were plotted and the resulting titration curves were evaluated by the expression of Equation (1) in the Prism software package (Graphpad Software). The analyses were conducted assuming an inhibitor/protease stoichiometry of n=1.

$$V_i/V_0 = Y\text{-Intercept} + \text{slope}*[ecotin] \qquad \text{Equation (1)}$$

The fit value for the X-Intercept, extrapolated from Equation (1), was then used to determine the active site titration (AST) concentration of the stock FXa solution and the "Fraction Active" value, assuming the total concentration of the protease was known and the ecotin was active at the concentrations used to generate the dose response curve, using Equation (2). Only values that were defined by the linear loss of activity (0%-90%) for increasing concentrations of ecotin were evaluated.

$$([X\text{-Intercept}]_{fit\text{-}value}/[FXa]_{assay})*[FXa]_{total\,protein} = [FXa]_{Ecotin\text{-}AST} \qquad \text{Equation (2)}$$

Example 4

Determination of the Catalytic Activity of FXa for its Substrate, Prothrombin (FII)

The catalytic activities of FXa and FXa variants for its substrate, prothrombin (FII), were evaluated in both the presence (cofactor-dependent) and absence (cofactor-independent) of plasma purified FVa and phospholipids. The respective catalytic activities were assessed indirectly using a fluorogenic assay, in which the fluorescence generated by thrombin (FIIa)-mediated cleavage of the synthetic substrate Pefafluor TH(H-D-CHA-Ala-Arg-AMC; Centerchem) was used to evaluate FXa cleavage of prothrombin (FII) to generate thrombin (FIIa).

A range of prothrombin concentrations were used to calculate the kinetic rate constants where the substrate protease (prothrombin) was in excess by at least 1000-fold over the concentration of the activating protease (FXa) for cofactor-dependent assays and at least 10 to 1000-fold over the concentration of activating protease (FXa) for cofactor-independent assays depending on variant activity. Briefly, the following assay provides a measure of the kinetics of prothrombinase-catalyzed prothrombin activation by directly observing the activity of thrombin on its substrate, Pefafluor TH, in a kinetic assay measured over the course of 30-60 minutes at room temperature (25° C.). For the determination of the kinetic constants of FXa/prothrombinase function ($k_{cat}$ and $K_M$), experiments were conducted with a limiting amount of Factor Xa in the presence or absence of a fixed saturating amount of Factor Va (20 nM) and PC/PS containing phospholipid vesicles (20 μM) at increasing concentrations of prothrombin (between 0 and 8 μM). The release of the free fluorophore, AMC (7-amino-4-methylcoumarin) following catalysis of Pefafluor TH by thrombin was then assessed continuously over the course of the reaction and the kinetic rate constants of the FXa variants determined.

A. FVa-Dependent Assay Protocol

For assays evaluating the kinetic rate of prothrombin (FII) activation by FXa in the presence of FVa (plasma purified, Heamatologic Technologies, Inc.) and phospholipids (75% phosphatidylcholine (PC)/25% phospatidylserine (PS); PC/PS vesicles ~120 nm in diameter; Avanti Polar Lipids), FXa variants were expressed, purified, activated, and active site titrated as described in Examples 1-3, above. FXa variants were then serially diluted to a 2× concentration of 0.2 μM in a 2 mL volume of 1× Buffer A (20 mM Hepes/150 mM NaCl/5 mM $CaCl_2$/0.1% BSA/0.1% PEG-8000, pH 7.4) containing 2× concentrations of FVa (40 nM) and PC/PS vesicles (40 μM).

A solution of 5 μM DFP/FPR-cmk treated prothrombin (FII) was prepared in 2.0 mL of 1× Buffer A containing 0.1 mM Pefafluor TH substrate. This represented the highest concentration of prothrombin tested and provided a sufficient volume for 3 assay plates. The prothrombin/Pefafluor TH solution was then serially diluted 1.8-fold in an 12-channel deep-well polypropylene plate with a final volume of 700 μL 1× Buffer A that contains 0.1 mM Pefafluor TH, resulting in final dilutions of 5000 nM, 2778 nM, 1543 nM, 857 nM, 476 nM, 265 nM, 147 nM, 82 nM, 45 nM, 25 nM, 14 nM and 0 nM prothrombin. A total of 25 μL of each prothrombin dilution series was aliquoted in up to three 96-well black half-area assay plates. Assay reactions were typically initiated using a BioMek FX liquid handling system or 12-channel micropipette to dispense 25 μL of the prothrombinase solutions (FXa/FVa/Phospholipids/$Ca^{2+}$) into three assay plates containing the 25 μL prothrombin dilution series according to a predefined plate map (4 FXa variants/plate).

The final concentrations of the reagents in the assay were as follows: 0.1 pM FXa, 20 nM FVa, 20 μM PC/PS vesicles, 50 μM Pefafluor TH, and prothrombin dilutions of 0 nM to 2500 nM. Reactions were monitored in a SpectraMax fluorescence plate reader for 30 min at 25° C. A standard curve of free AMC served as the conversion factor for RFU to μM in the data analysis calculations using a dose range that covered 0 μM to 100 μM AMC.

B. FVa-Independent Assay Protocol

For assays evaluating the kinetic rate of prothrombin (FII) activation by FXa in the absence of FVa, but in the presence of phospholipids (75% phosphatidylcholine (PC)/25% phospatidylserine (PS); PC/PS vesicles ~120 nm in diameter; Avanti Polar Lipids), FXa variants were expressed, purified, activated, and active site titrated as described in examples 1-3, above. FXa variants were then serially diluted to a 2× concentration of 20 pM (wild-type) or 1 nM-4 nM (for FXa variants) in a 2 mL volume of 1× Buffer A containing a 2× concentration of PC/PS vesicles (40 μM). A solution of 8 μM DFP/FPR-cmk treated prothrombin (FII) was prepared in 2.0 mL of 1× Buffer A containing 0.1 mM Pefafluor TH substrate. This represented the highest concentration of prothrombin tested and provided a sufficient volume for up to 3 assay plates. The prothrombin/Pefafluor TH solution was then serially diluted 1.8-fold in an 12-channel deep-well polypropylene plate with a final volume of 700 μL 1× Buffer A that contains 0.1 mM Pefafluor TH, resulting in final dilutions of 8000 nM, 4444 nM, 2469 nM, 1372 nM, 762 nM, 423 nM, 235 nM, 131 nM, 73 nM, 40 nM, 22 nM and 0 nM prothrombin. A total of 25 μL of each prothrombin dilution series was aliquoted in up to three 96-well black half-area assay plates. Assay reactions were typically initiated using a BioMek FX liquid handling system or 12-channel micropipette to dispense 25 μL of the FVa-independent prothrombinase solutions (FXa/Phospholipids/$Ca^{2+}$) into three assay plates containing the 25 μL prothrombin dilution series according to a predefined plate map (4 FXa variants/plate).

The final concentrations of the reagents in the assay were as follows: 10 μM FXa or 0.5-2 nM FXa variant, 20 μM PC/PS vesicles, 50 μM Pefafluor TH, and prothrombin (FII) dilutions of 0 nM to 4000 nM. Reactions were monitored in a SpectraMax fluorescence plate reader for 30 min at 25° C. A standard curve of free AMC served as the conversion factor for RFU to μM in the data analysis calculations using a dose range that covered 0 μM to 100 μM AMC.

C. Data Analysis

All equations used to determine the steady-state kinetics of the catalysis of prothrombin (FII) by FXa are based on those described in the reference "Zymogen-Activation Kinetics Modulatory effects of trans-4-(aminomethyl)cyclohexane-1-carboxylic acid and poly-D-lysine on plasminogen activation" in Petersen, et al. (1985) *Biochem. J.* 225:149-158. The theory for the steady-state kinetics of the system described by Scheme A below is described by the expression of equation (3) that represents a parabolic accumulation of product.

Scheme A:

FXa/FVa/Phospholipid/$Ca^{2+}$ (Prothrombinase Complex)

↓

Prothrombin (FII) ⟶ Thrombin (FIIa)

↓

Pefafluor TH Substrate ⟶ Product Release

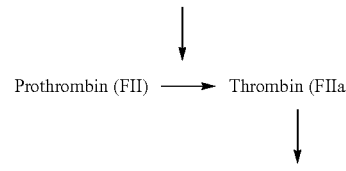

$$p = a_0 \frac{k_a[z_0]}{K_z + [z_0]} * \frac{k_e[S_0]}{K_s + [S_0]} * \frac{t^2}{2} \quad \text{Equation (3)}$$

According to the mechanism of Scheme A, $a_0$ is the concentration of activating protease (FXa), $z_0$ is the concentration of zymogen (FII), $k_a$ and $K_z$ represent the $k_{cat}$ and $K_M$ for the activator-catalyzed conversion of zymogen to active enzyme (FIIa), whereas $k_e$ and $K_s$ represent the $k_{cat}$ and $K_M$ for conversion of substrate to product by FIIa over a given time t.

For analysis of progress curves, equation (3) was re-cast in the form of equation (4) where the steady-state kinetics of prothrombin hydrolysis of the fluorogenic substrate were determined independently and replaced by the compound constant $k_2$.

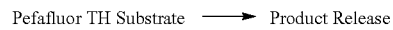

$$p = a_0 \frac{k_a[z_0]}{K_z + [z_0]} * k_2 * \frac{t^2}{2} \quad \text{Equation (4)}$$

The thrombin (FIIa) activity on Pefafluor TH in 1× Buffer A was independently determined to have a $K_M$ of 5.7 μM and a $k_{cat}$ value of 40.4 $s^{-1}$. Substitution of these values into equation (5) gave a $k_2$ correction factor of 36.3 $s^{-1}$.

$$k_2 = \frac{k_e[S_0]}{K_M + [S_0]} \quad \text{Equation (5)}$$

To determine the degree of FXa catalytic activity, raw data collected with the SoftMax Pro application (Molecular Devices) were exported as or .TXT files. Further non-linear data analyses were performed directly within the Activity-Base software package using the XE Runner data analysis module (IDBS Software). The spreadsheet template was set up to automatically fit the parabolic reaction velocities (μM/$sec^2$) of the tested FXa variants at each prothrombin concentration to the function of a standard rectangular hyperbola (i.e.

Michaelis Menten equation) given by equation (6) to yield the fit values for $V_{max}$ and $K_M$.

$$\text{Reaction Velocity } (\mu M/\text{sec}^2) = \frac{V_{max}[S_0]}{K_M + [S_0]} \quad \text{Equation (6)}$$

The $k_{cat}$ value for the tested FXa variant was then calculated from the fit value for $V_{max}$ ($\mu$M/sec$^2$) by equation (7).

$$k_{cat} = \frac{V_{max}}{[FXa] * 0.5 * k_2} \quad \text{Equation (7)}$$

The specificity constant $k_{cat}/K_m$ was calculated directly from the fit value of $K_M$ and the calculated $k_{cat}$ that arose from evaluation of equation (7) above.

D. Results

Tables 17-18 below set forth the kinetic parameters used to calculate the catalytic activity, set forth in Table 19, for each of the FXa variants assayed in the presence and absence of the FXa cofactor (FVa). The fit value of the Michaelis-Menten constant, $K_m$, and the calculated catalytic rate constant, $k_{cat}$, for each of the FXa mutants, as well as recombinant wild-type FXa (designated FXa WT) and plasma purified FXa (Haematologic Technologies, Inc), are provided in Tables 17 and 18, respectively, below. Tables 17 and 18 also provide the standard deviation (S.D.), coefficient of variation (as a percentage; % CV) and the number of assays performed (n) for the $K_M$ and $k_{cat}$ kinetic parameters. Each of the kinetic parameters was determined for FXa mutants in the presence and absence of the FXa cofactor, FVa.

The calculated $k_{cat}$ values for FXa polypeptides, set forth in Table 18 were divided by the fit values of $K_M$, set forth in Table 17, to generate the kinetic constant for catalytic activity, $k_{cat}/K_M$ (M$^{-1}$ s$^{-1}$). The catalytic activities of the FXa mutants are set forth in Table 19 as the catalytic activity constant, and also as the percentage of the activity of wild-type FXa. Also presented in Table 19 is the relative cofactor dependence (last column), wherein the cofactor dependence is defined as the ratio of the catalytic activity ($k_{cat}/K_M$) in the presence of FVa (FVa-dependent catalytic activity) divided by the catalytic activity ($k_{cat}/K_M$) in the absence of FVa (FVa-independent catalytic activity).

Where the activity of the FXa variant was compared to wild-type FXa (% of WT $k_{cat}/K_M$), it was compared to a recombinant wild-type FXa polypeptide (FXa WT) that was expressed and purified using the same conditions as used for the variant FXa polypeptides to ensure that any differences in activity were the result of the mutation(s), and not the result of differences in, for example, post-translational modifications associated with different expression systems. Thus, the wild-type FXa polypeptide used for comparison was the recombinant wild-type FXa generated from cloning the FX gene, whose sequence is set forth in SEQ ID NO:1, and expressed from CHO cells as a polypeptide whose amino acid sequence is set forth as amino acids 1-139 and 195-448 of SEQ ID NO:134, as described in Example 2.

The observed catalytic activities ($k_{cat}/K_M$ in Table 19) of the FXa variants ranged from no detectable prothrombinase activity in a few variants (e.g. FXa-G197P, FXa-G198A, FXa-D378N and FXa-I195L/V196S) to a slight increase in $k_{cat}/K_M$ for the activation of prothrombin (FII) compared to wild-type FXa (eg. FXa-L65N/E67SN196S, FXa-R236V, FXa-V196S and FXa-L211S/G219H). Some of the variants displayed markedly increased cofactor dependence compared to the wild-type FXa, including FXa-V196S, FXa-K3385, FXa-I195L, FXa-G197S, and combinations thereof, such as FXa-V196S/K338S, FXa-V196S/R326M, FXa-V196S/R326N, FXa-V196S/K276E and FXa-V196S/R332G. The improved cofactor dependence observed was due mainly to a decrease in the activity of FXa variants in the absence of FVa, however, some variants also showed lower substrate affinity in the absence of co-factor, demonstrated by 3 to -5-fold lower $K_M$ values in FVa-Dependent assays (Table 17).

Several FXa variants, mutated to provide single or multiple additional glycosylation sites, demonstrated close to wild-type activity (e.g. FXa-E82N/F84SN196S, FXa-G114N/V196S/E264N/E266S, FXa-V196S/E264N/E266S/K388N and FXa-G114N/V196S/L211S/G219H); while others showed reduced catalytic activity.

TABLE 17

Fit value of $K_M$ for FXa Mutants

| Mutation (Mature FX Numbering) | Mutation (Chymotrypsin Numbering) | FVa Present | | | | No FVa | | | |
|---|---|---|---|---|---|---|---|---|---|
| | | $K_M$ (nM) | ±S.D. (nM) | % CV | n | $K_M$ (nM) | ±S.D. (nM) | % CV | n |
| Plasma FXa | Plasma FXa | 146.0 | 49.9 | 34% | 120 | 145.5 | 44.4 | 31% | 100 |
| FX WT | FX WT | 165.2 | 78.0 | 47% | 38 | 127.9 | 22.0 | 17% | 16 |
| I195L | I16L | 101.8 | 41.5 | 41% | 28 | 145.6 | 63.5 | 44% | 10 |
| V196I | V17I | 129.5 | 3.1 | 2% | 2 | 136.7 | 11.0 | 8% | 2 |
| V196S | V17S | 78.2 | 22.0 | 28% | 47 | 252.5 | 185.5 | 73% | 25 |
| T85N/K87S/V196S | T[85]N/K[87]S/V17S | 38.6 | 3.1 | 8% | 3 | 499.5 | 334.2 | 67% | 3 |
| Q56N/Q58S/V196S | Q[56]N/Q[58]S/V17S | 76.9 | 29.9 | 39% | 3 | 384.8 | 352.7 | 92% | 3 |
| K62N/G64S/V196S | K[62]N/G[64]S/V17S | 109.7 | 16.5 | 15% | 2 | 461.8 | 360.4 | 78% | 3 |
| L65N/E67S/V196S | L[65]N/E[67]S/V17S | 60.8 | 13.4 | 22% | 2 | 977.7 | 766.2 | 78% | 3 |
| E67N/V196S | E[67]N/V17S | 107.4 | 29.2 | 27% | 3 | 713.2 | 34.2 | 5% | 2 |
| L73N/G75S/V196S | L[73]N/G[75]S/V17S | 66.7 | 13.8 | 21% | 3 | 645.7 | 502.7 | 78% | 3 |
| G75N/E77S/V196S | G[75]N/E[77]S/V17S | 63.7 | 20.7 | 33% | 2 | 305.5 | 209.9 | 69% | 3 |
| R86N/L88S/V196S | R[86]N/L[88]S/V17S | 98.7 | 22.2 | 22% | 3 | 105.1 | 41.8 | 40% | 3 |
| G114N/V196S | G[114]N/V17S | 113.4 | 39.1 | 34% | 6 | 1310.5 | 976.3 | 75% | 4 |
| D95N/D97S/V196S | D[95]N/D[97]S/V17S | 53.6 | 18.7 | 35% | 4 | 1422.5 | 534.3 | 38% | 4 |
| E82/V196S | E[82]S/V17S | 48.5 | 12.3 | 25% | 9 | 194.1 | 110.0 | 57% | 10 |
| E82N/F84S/V196S | E[82]N/F[84]S/V17S | 70.6 | 19.7 | 28% | 2 | 593.9 | 198.7 | 33% | 5 |
| G78N/N80S/V196S | G[78]N/N[80]S/V17S | 53.7 | 17.2 | 32% | 4 | 443.0 | 457.1 | 103% | 5 |
| E77N/K79S/V196S | E[77]N/K[79]S/V17S | 88.9 | 33.3 | 37% | 4 | 398.2 | 173.4 | 44% | 4 |

TABLE 17-continued

Fit value of $K_M$ for FXa Mutants

| Mutation (Mature FX Numbering) | Mutation (Chymotrypsin Numbering) | FVa Present | | | | No FVa | | | |
|---|---|---|---|---|---|---|---|---|---|
| | | $K_M$ (nM) | ±S.D. (nM) | % CV | n | $K_M$ (nM) | ±S.D. (nM) | % CV | n |
| D119N/G121S/ V196S | D[119]N/G[121]S/ V17S | 108.5 | 24.7 | 23% | 4 | 748.9 | 526.4 | 70% | 4 |
| L83N/V196S | L[83]N/V17S | 78.5 | 26.5 | 34% | 4 | 266.2 | 74.8 | 28% | 3 |
| K122S/V196S | K[122]S/V17S | 134.1 | 32.4 | 24% | 6 | 978.3 | 383.3 | 39% | 5 |
| E51N/V196S | E[51]N/V17S | 118.6 | 18.9 | 16% | 2 | 959.7 | 278.1 | 29% | 2 |
| Q58N/K60S/V196S | Q[58]N/K[60]S/V17S | 97.9 | 10.9 | 11% | 2 | 911.0 | 215.4 | 24% | 2 |
| G114N/D119N/ G121S/V196S | G[114]N/D[119]N/ G[121]S/V17S | 54.9 | 15.6 | 28% | 4 | 92.0 | 25.0 | 27% | 4 |
| G198A | G19A | No Activity | n.d. | n.d. | 0 | n.d. | n.d. | n.d. | 0 |
| G198V | G19V | No Activity | n.d. | n.d. | 0 | n.d. | n.d. | n.d. | 0 |
| G198R | G19R | No Activity | n.d. | n.d. | 0 | n.d. | n.d. | n.d. | 0 |
| G198K | G19K | No Activity | n.d. | n.d. | 0 | n.d. | n.d. | n.d. | 0 |
| G198P | G19P | No Activity | n.d. | n.d. | 0 | n.d. | n.d. | n.d. | 0 |
| G198H | G19H | No Activity | n.d. | n.d. | 0 | n.d. | n.d. | n.d. | 0 |
| L211S/G219H | L32S/G40H | | 11.7 | 18% | 2 | 112.1 | 7.1 | 6% | 2 |
| G197P | G18P | No Activity | n.d. | n.d. | 0 | n.d. | n.d. | n.d. | 0 |
| D378N | D194N | No Activity | n.d. | n.d. | 0 | n.d. | n.d. | n.d. | 0 |
| D378S | D194S | No Activity | n.d. | n.d. | 0 | n.d. | n.d. | n.d. | 0 |
| V196L | V17L | 107.9 | 11.4 | 11% | 2 | 137.1 | 42.9 | 31% | 2 |
| V196T | V17T | 116.4 | 11.5 | 10% | 2 | 138.8 | 13.8 | 10% | 2 |
| V196P | V17P | No Activity | n.d. | n.d. | 0 | n.d. | n.d. | n.d. | 0 |
| G197V | G18V | No Activity | n.d. | n.d. | 0 | n.d. | n.d. | n.d. | 0 |
| G197T | G18T | No Activity | n.d. | n.d. | 0 | n.d. | n.d. | n.d. | 0 |
| G197S | G18S | 103.4 | 4.0 | 4% | 2 | 153.9 | 11.6 | 8% | 2 |
| E200A | E21A | 116.8 | 5.6 | 5% | 2 | 158.9 | 11.9 | 7% | 2 |
| E200S | E21S | 157.3 | 14.5 | 9% | 2 | 124.1 | 46.1 | 37% | 2 |
| E200V | E21V | 127.7 | 6.9 | 5% | 2 | 158.8 | 22.7 | 14% | 2 |
| K202S | K23S | 105.5 | 1.4 | 1% | 2 | 152.4 | 28.9 | 19% | 2 |
| R326A | R143A | 119.8 | 25.5 | 21% | 2 | 143.2 | 46.2 | 32% | 2 |
| R326S | R143S | 101.2 | 10.2 | 10% | 2 | 136.9 | 82.7 | 60% | 2 |
| R326T | R143T | 81.3 | 1.4 | 2% | 2 | 142.0 | 87.1 | 61% | 2 |
| R326V | R143V | 63.0 | 22.1 | 35% | 2 | 193.5 | 38.8 | 20% | 2 |
| R326Q | R143Q | 69.4 | 9.1 | 13% | 2 | 143.1 | 86.1 | 60% | 2 |
| R326N | R143N | 82.5 | 5.2 | 6% | 2 | 136.2 | 82.6 | 61% | 2 |
| R326M | R143M | 78.7 | 5.1 | 6% | 2 | 174.3 | 41.2 | 24% | 2 |
| R326K | R143K | 114.2 | 19.6 | 17% | 2 | 158.1 | 16.9 | 11% | 2 |
| R326Y | R143Y | 68.2 | 14.6 | 21% | 2 | 144.8 | 29.8 | 21% | 2 |
| T327A | T144A | 116.5 | 24.8 | 21% | 2 | 169.3 | 60.7 | 36% | 2 |
| T327L | T144L | 127.1 | 32.8 | 26% | 3 | 198.1 | 91.9 | 46% | 2 |
| S334A | S152A | 115.4 | 18.0 | 16% | 2 | 150.0 | 67.1 | 45% | 2 |
| S334T | S152T | 106.6 | 24.3 | 23% | 2 | 160.4 | 52.0 | 32% | 2 |
| S334N | S152N | 95.6 | 22.6 | 24% | 2 | 160.7 | 58.3 | 36% | 2 |
| R336E | R154E | 105.7 | 20.2 | 19% | 3 | 158.3 | 39.4 | 25% | 2 |
| K338A | K156A | 100.0 | 20.1 | 20% | 5 | 168.5 | 34.3 | 20% | 4 |
| K338S | K156S | 109.7 | 18.3 | 17% | 5 | 167.1 | 20.6 | 12% | 4 |
| K338N | K156N | 115.0 | 40.6 | 35% | 3 | 159.6 | 60.8 | 38% | 2 |
| K338R | K156R | 112.2 | 4.0 | 4% | 2 | 182.4 | 55.9 | 31% | 2 |
| K338V | K156V | 90.1 | 24.4 | 27% | 2 | 158.7 | 35.3 | 22% | 2 |
| K338Y | K156Y | 151.8 | 0.5 | 0% | 2 | 167.1 | 35.2 | 21% | 2 |
| K338M | K156M | 180.3 | 26.3 | 15% | 2 | 180.0 | 27.8 | 15% | 2 |
| T327A/K338A | T144A/K156A | 187.9 | 19.9 | 11% | 2 | 255.8 | 47.3 | 18% | 2 |
| T327L/K338M | T144L/K156M | 151.7 | 11.1 | 7% | 2 | 174.8 | 27.1 | 16% | 2 |
| E200V/T327L/ K338M | E21V/T144L/K156M | 125.8 | 9.5 | 8% | 2 | 163.4 | 33.4 | 20% | 2 |
| E200V/T327L/S334A/ K338M | E21V/T144L/S152A/ K156M | 70.0 | 7.3 | 10% | 2 | 171.7 | 11.9 | 7% | 2 |
| V196S/G197A | V17S/G18A | No Activity | n.d. | n.d. | 0 | n.d. | n.d. | n.d. | 0 |
| V196S/L211S/G219H | V17S/L32S/G40H | 48.2 | 11.5 | 24% | 11 | 116.1 | 12.3 | 11% | 2 |
| D119N/G121S/V196S/ L211S/G219H | D[119]N/G[121]S/ V17S/L32S/G40H | 41.3 | 23.0 | 56% | 2 | 101.5 | 52.0 | 51% | 2 |

TABLE 17-continued

Fit value of $K_M$ for FXa Mutants

| Mutation (Mature FX Numbering) | Mutation (Chymotrypsin Numbering) | FVa Present | | | | No FVa | | | |
|---|---|---|---|---|---|---|---|---|---|
| | | $K_M$ (nM) | ±S.D. (nM) | % CV | n | $K_M$ (nM) | ±S.D. (nM) | % CV | n |
| G114N/V196S/L211S/G219H | G[114]N/V17S/L32S/G40H | 37.3 | 17.1 | 46% | 2 | 76.2 | 21.0 | 28% | 2 |
| G114N/D119N/G121S/V196S/L211S/G219H | G[114]N/D[119]N/G[121]S/V17S/L32S/G40H | 41.4 | 18.2 | 44% | 3 | 132.1 | 55.9 | 42% | 4 |
| G197A/L211S/G219H | G18A/L32S/G40H | 96.1 | 28.9 | 30% | 2 | 114.0 | 26.6 | 23% | 3 |
| V196S/G197A/L211S/G219H | V17S/G18A/L32S/G40H | No Activity | n.d. | n.d. | 0 | n.d. | n.d. | n.d. | 0 |
| I195L/V196S | I16L/V17S | No Activity | n.d. | n.d. | 0 | n.d. | n.d. | n.d. | 0 |
| I195L/G197A | I16L/G18A | No Activity | n.d. | n.d. | 0 | n.d. | n.d. | n.d. | 0 |
| I195L/L211S/G219H | I16L/L32S/G40H | 111.0 | 44.4 | 40% | 4 | 257.4 | 147.8 | 57% | 5 |
| V196S/N214D | V17S/N35D | 63.4 | 6.4 | 10% | 3 | 250.7 | 0.1 | 0% | 2 |
| V196S/N214A | V17S/N35A | 82.9 | 16.1 | 19% | 2 | 185.1 | 57.9 | 31% | 2 |
| V196S/N214S | V17S/N35S | 79.5 | 9.4 | 12% | 2 | 158.1 | 24.4 | 15% | 2 |
| V196S/E216R | V17S/E37R | 59.1 | 7.9 | 13% | 3 | 269.3 | 2.9 | 1% | 2 |
| V196S/E216K | V17S/E37K | 70.0 | 1.0 | 1% | 2 | 258.3 | 132.8 | 51% | 2 |
| V196S/E216A | V17S/E37A | 66.6 | 4.7 | 7% | 2 | 268.6 | 91.8 | 34% | 2 |
| V196S/E216S | V17S/E37S | 79.5 | 19.0 | 24% | 2 | 165.7 | 80.4 | 49% | 2 |
| V196S/E218R | V17S/E39R | 64.3 | 15.8 | 25% | 3 | 231.9 | 7.1 | 3% | 2 |
| V196S/E218K | V17S/E39K | 76.6 | 9.4 | 12% | 2 | 204.2 | 41.1 | 20% | 2 |
| V196S/E218A | V17S/E39A | 79.2 | 6.3 | 8% | 2 | 217.1 | 5.3 | 2% | 2 |
| V196S/R332A | V17S/R150A | 67.8 | 19.5 | 29% | 4 | 372.0 | 82.3 | 22% | 3 |
| V196S/R332D | V17S/R150D | 87.0 | 53.1 | 61% | 5 | 149.2 | 53.1 | 36% | 5 |
| V196S/R332E | V17S/R150E | 55.1 | 14.2 | 26% | 2 | 178.2 | 68.3 | 38% | 2 |
| V196S/R332S | V17S/R150S | 70.6 | 32.2 | 46% | 6 | 147.0 | 33.9 | 23% | 5 |
| V196S/R332G | V17S/R150G | 54.5 | 21.7 | 40% | 5 | 192.8 | 74.8 | 39% | 4 |
| V196S/R326E | V17S/R143E | n.d. | n.d. | n.d. | 0 | n.d. | n.d. | n.d. | 0 |
| V196S/R326D | V17S/R143D | 18.8 | 8.9 | 48% | 5 | 2169.5 | 32.5 | 1% | 2 |
| V196S/R326M | V17S/R143M | 39.4 | 1.4 | 3% | 2 | 265.9 | 72.4 | 27% | 2 |
| V196S/R326N | V17S/R143N | 20.1 | 3.6 | 18% | 3 | 338.3 | 100.5 | 30% | 2 |
| V196S/R326Q | V17S/R143Q | 22.1 | 5.8 | 26% | 12 | 892.1 | 577.8 | 65% | 3 |
| V196S/R273E | V17S/R93E | 58.7 | 4.9 | 8% | 3 | 199.1 | 38.2 | 19% | 2 |
| V196S/R273A | V17S/R93A | 62.6 | 10.7 | 17% | 2 | 152.0 | 34.4 | 23% | 2 |
| V196S/R424A | V17S/R240A | 65.0 | 15.9 | 25% | 2 | 107.3 | 1.5 | 1% | 2 |
| V196S/R424E | V17S/R240E | 66.3 | 5.5 | 8% | 7 | 173.2 | 70.8 | 41% | |
| V196S/K420A | V17S/K236A | 54.7 | 20.3 | 37% | 2 | 70.9 | 24.1 | 34% | 2 |
| V196S/K420E | V17S/K236E | 49.9 | 16.0 | 32% | 2 | 102.2 | 13.1 | 13% | 2 |
| V196S/R306E | V17S/R125A | 66.6 | 3.8 | 6% | 2 | 110.5 | n.d. | n.d. | 1 |
| V196S/K276A | V17S/K96A | 58.3 | 11.6 | 20% | 2 | 339.1 | 96.2 | 28% | 2 |
| V196S/K276E | V17S/K96E | 47.0 | 8.1 | 17% | 2 | 436.6 | 51.1 | 12% | 2 |
| V196S/K420E/R424E | V17S/K236E/R240E | 60.0 | 22.0 | 37% | 3 | 167.5 | 111.4 | 67% | 2 |
| V196S/R273E/K420E/R424E | V17S/R93E/K236E/R240E | n.d. | n.d. | n.d. | 0 | n.d. | n.d. | n.d. | 0 |
| V196S/R273E/R306E/K420E/R424E | V17S/R93E/R125E/K236E/R240E | No Activity | n.d. | n.d. | 0 | n.d. | n.d. | n.d. | 0 |
| V196S/K338A | V17S/K156A | 17.5 | 2.8 | 16% | 2 | 820.8 | 417.6 | 51% | 2 |
| V196S/K338S | V17S/K156S | 17.9 | 5.1 | 29% | 10 | 2996.2 | 1390.0 | 46% | 8 |
| V196S/E215N/N217S | V17S/E36N/N38S | 151.7 | 32.4 | 21% | 3 | 1078.5 | 634.6 | 59% | 4 |
| V196S/E264N/E266S | V17S/E84N/E86S | 97.4 | 16.0 | 16% | 4 | 948.7 | 447.3 | 47% | 4 |
| D119N/G121S/V196S/E264N/E266S | D[119]N/G[121]S/V17S/E84N/E86S | 101.1 | 69.8 | 69% | 2 | 179.5 | 89.6 | 50% | 2 |
| G114N/V196S/E264N/E266S | G[114]N/V17S/E84N/E86S | 57.1 | 19.4 | 34% | 2 | 88.0 | 51.4 | 58% | 2 |
| V196S/R429N/L431S | V17S/R245N/L247S | 110.7 | 4.7 | 4% | 2 | 512.1 | 122.8 | 24% | 2 |
| V196S/R243N/K245S | V17S/R63N/K65S | 33.2 | 4.2 | 13% | 3 | 86.2 | 57.9 | 67% | 2 |
| V196S/T293N/R295S | V17S/T113N/R115S | 154.9 | 45.9 | 30% | 2 | 944.4 | 379.5 | 40% | 2 |
| V196S/D389N/Y391S | V17S/D205N/Y207S | 119.8 | 98.2 | 82% | 2 | 95.9 | 62.6 | 65% | 3 |
| V196S/K388N | V17S/K204N | 134.0 | 54.7 | 41% | 5 | 1522.3 | 969.2 | 64% | 4 |
| D119N/G121S/V196S/K388N | D[119]N/G[121]S/V17S/K204N | 61.4 | 25.3 | 41% | 2 | 63.7 | 13.9 | 22% | 2 |
| V196S/T428N/G430S | V17S/T244N/G246S | 88.5 | 23.9 | 27% | 2 | 839.1 | 63.1 | 8% | 2 |
| V196S/L211S/G219H/E264N/E266S | V17S/L32S/G40H/E84N/E86S | 30.7 | 7.2 | 23% | 3 | 166.0 | 44.8 | 27% | 2 |
| D119N/G121S/V196S/L211S/G219H/E264N/E266S | D[119]N/G[121]S/V17S/L32S/G40H/E84N/E86S | 40.5 | 8.1 | 20% | 2 | 75.5 | 18.9 | 25% | 2 |
| G114N/V196S/L211S/G219H/E264N/E266S | G[114]N/V17S/L32S/G40H/E84N/E86S | 62.4 | 21.0 | 34% | 4 | 77.5 | 17.9 | 23% | 2 |
| V196S/E264N/E266S/K388N | V17S/E84N/E86S/K204N | 64.2 | 36.0 | 56% | 2 | 66.8 | 15.3 | 23% | 2 |

TABLE 17-continued

Fit value of $K_M$ for FXa Mutants

| Mutation (Mature FX Numbering) | Mutation (Chymotrypsin Numbering) | FVa Present | | | | No FVa | | | |
|---|---|---|---|---|---|---|---|---|---|
| | | $K_M$ (nM) | ±S.D. (nM) | % CV | n | $K_M$ (nM) | ±S.D. (nM) | % CV | n |
| D119N/G121S/V196S/L211S/G219H/K388N | D[119]N/G[121]S/V17S/L32S/G40H/K204N | 57.2 | 24.5 | 43% | 3 | 68.0 | 22.9 | 34% | 2 |
| G114N/V196S/L211S/G219H/K388N | G[114]N/V17S/L32S/G40H/K204N | 95.7 | 52.5 | 55% | 4 | 71.4 | 23.3 | 33% | 2 |
| V196S/L211S/G219H/E264N/E266S/K388N | V17S/L32S/G40H/E84N/E86S/K204N | 74.6 | 1.0 | 1% | 2 | 133.9 | 43.3 | 32% | 2 |

TABLE 18

Calculated $k_{cat}$ of FXa Mutants

| Mutation (Mature FX Numbering) | Mutation (Chymotrypsin Numbering) | FVa Present | | | | No FVa | | | |
|---|---|---|---|---|---|---|---|---|---|
| | | $k_{cat}$ (s$^{-1}$) | ±S.D. (s$^{-1}$) | % CV | n | $k_{cat}$ (s$^{-1}$) | ±S.D. (s$^{-1}$) | % CV | n |
| Plasma FXa | Plasma FXa | 46.4 | 16.4 | 35% | 120 | 1.6E−02 | 6.3E−03 | 40% | 100 |
| FX WT | FX WT | 37.8 | 14.7 | 39% | 38 | 9.5E−03 | 4.1E−03 | 44% | 16 |
| I195L | I16L | 31.2 | 8.6 | 27% | 28 | 3.1E−04 | 9.4E−05 | 30% | 10 |
| V196I | V17I | 28.3 | 4.7 | 17% | 2 | 3.0E−03 | 8.6E−05 | 3% | 2 |
| V196S | V17S | 31.7 | 10.9 | 34% | 47 | 3.8E−05 | 8.1E−06 | 22% | 25 |
| T85N/K87S/V196S | T[85]N/K[87]S/V17S | 3.8 | 0.8 | 20% | 3 | 5.8E−05 | 4.1E−05 | 70% | 3 |
| Q56N/Q58S/V196S | Q[56]N/Q[58]S/V17S | 21.1 | 6.4 | 30% | 3 | 5.3E−05 | 3.7E−05 | 71% | 3 |
| K62N/G64S/V196S | K[62]N/G[64]S/V17S | 42.8 | 0.2 | 0% | 2 | 8.5E−05 | 6.2E−05 | 72% | 3 |
| L65N/E67S/V196S | L[65]N/E[67]S/V17S | 27.9 | 9.2 | 33% | 2 | 1.3E−04 | 8.3E−05 | 65% | 3 |
| E67N/V196S | E[67]N/V17S | 28.9 | 13.9 | 48% | 3 | 7.2E−05 | 1.8E−06 | 3% | 2 |
| L73N/G75S/V196S | L[73]N/G[75]S/V17S | 10.9 | 3.0 | 27% | 3 | 6.6E−05 | 4.6E−05 | 70% | 3 |
| G75N/E77S/V196S | G[75]N/E[77]S/V17S | 14.8 | 4.1 | 28% | 2 | 5.5E−05 | 2.9E−05 | 52% | 3 |
| R86N/L88S/V196S | R[86]N/L[88]S/V17S | 30.0 | 16.0 | 53% | 3 | 7.3E−05 | 2.8E−05 | 39% | 3 |
| G114N/V196S | G[114]N/V17S | 21.4 | 7.0 | 33% | 6 | 1.4E−04 | 8.2E−05 | 60% | 4 |
| D95N/D97S/V196S | D[95]N/D[97]S/V17S | 13.5 | 3.1 | 23% | 4 | 5.5E−05 | 1.3E−05 | 53% | 4 |
| E82S/V196S | E[82]S/V17S | 7.2 | 3.8 | 53% | 9 | 1.7E−05 | 5.4E−06 | 32% | 10 |
| E82N/F84S/V196S | E[82]N/F[84]S/V17S | 15.0 | 0.9 | 6% | 2 | 2.6E−05 | 7.6E−06 | 29% | 5 |
| G78N/N80S/V196S | G[78]N/N[80]S/V17S | 6.5 | 2.2 | 34% | 4 | 1.8E−05 | 9.6E−06 | 55% | 5 |
| E77N/K79S/V196S | E[77]N/K[79]S/V17S | 11.3 | 2.4 | 22% | 4 | 2.9E−05 | 9.0E−06 | 31% | 4 |
| D119N/G121S/V196S | D[119]N/G[121]S/V17S | 22.0 | 4.9 | 22% | 4 | 4.4E−05 | 2.7E−05 | 60% | 4 |
| L83N/V196S | L[83]N/V17S | 11.2 | 0.8 | 7% | 4 | 3.1E−05 | 1.0E−05 | 33% | 3 |
| K122S/V196S | K[122]S/V17S | 19.5 | 6.5 | 33% | 6 | 6.3E−05 | 3.1E−05 | 49% | 5 |
| E51N/V196S | E[51]N/V17S | 27.1 | 6.7 | 25% | 2 | 1.2E−04 | 2.3E−05 | 20% | 2 |
| Q58N/K60S/V196S | Q[58]N/K[60]S/V17S | 22.5 | 1.5 | 7% | 2 | 9.3E−05 | 1.6E−05 | 18% | 2 |
| G114N/D119N/G121S/V196S | G[114]N/D[119]N/G[121]S/V17S | 18.0 | 6.4 | 36% | 4 | 8.7E−06 | 2.1E−06 | 24% | 4 |
| G198A | G19A | No Activity | n.d. | n.d. | 0 | No Activity | n.d. | n.d. | 0 |
| G198V | G19V | No Activity | n.d. | n.d. | 0 | No Activity | n.d. | n.d. | 0 |
| G198R | G19R | No Activity | n.d. | n.d. | 0 | No Activity | n.d. | n.d. | 0 |
| G198K | G19K | No Activity | n.d. | n.d. | 0 | No Activity | n.d. | n.d. | 0 |
| G198P | G19P | No Activity | n.d. | n.d. | 0 | No Activity | n.d. | n.d. | 0 |
| G198H | G19H | No Activity | n.d. | n.d. | 0 | No Activity | n.d. | n.d. | 0 |
| L211S/G219H | L32S/G40H | 28.0 | 7.7 | 28% | 2 | 7.0E−03 | 7.1E−05 | 1% | 2 |
| G197P | G18P | No Activity | n.d. | n.d. | 0 | No Activity | n.d. | n.d. | 0 |
| D378N | D194N | No Activity | n.d. | n.d. | 0 | No Activity | n.d. | n.d. | 0 |
| D378S | D194S | No Activity | n.d. | n.d. | 0 | No Activity | n.d. | n.d. | 0 |
| VI96L | V17L | 39.8 | 5.1 | 13% | 2 | 1.1E−03 | 1.1E−04 | 10% | 2 |
| V196T | V17T | 39.4 | 8.0 | 20% | 2 | 2.8E−04 | 6.0E−05 | 22% | 2 |
| V196P | V17P | No Activity | n.d. | n.d. | 0 | No Activity | n.d. | n.d. | 0 |
| G197V | G18V | No Activity | n.d. | n.d. | 0 | No Activity | n.d. | n.d. | 0 |
| G197T | G18T | No Activity | n.d. | n.d. | 0 | No Activity | n.d. | n.d. | 0 |
| G197S | G18S | 20.7 | 1.7 | 8% | 2 | 1.6E−04 | 3.5E−05 | 23% | 2 |
| E200A | E21A | 29.6 | 6.8 | 23% | 2 | 1.5E−03 | 4.5E−04 | 29% | 2 |
| E200S | E21S | 17.7 | 1.7 | 9% | 2 | 2.8E−03 | 7.8E−04 | 27% | 2 |
| E200V | E21V | 30.2 | 5.5 | 18% | 2 | 2.1E−03 | 4.4E−04 | 22% | 2 |
| K202S | K23S | 39.1 | 1.7 | 4% | 2 | 1.6E−03 | 2.5E−05 | 2% | 2 |
| R326A | R143A | 19.4 | 2.6 | 13% | 2 | 6.1E−03 | 1.6E−03 | 27% | 2 |
| R326S | R143S | 17.2 | 1.6 | 9% | 2 | 2.6E−03 | 1.0E−03 | 39% | 2 |
| R326T | R143T | 16.8 | 0.5 | 3% | 2 | 2.2E−03 | 8.1E−04 | 36% | 2 |
| R326V | R143V | 27.0 | 1.7 | 6% | 2 | 4.7E−03 | 1.4E−03 | 30% | 2 |
| R326Q | R143Q | 16.5 | 0.1 | 1% | 2 | 1.5E−03 | 4.7E−04 | 30% | 2 |
| R326N | R143N | 18.9 | 0.9 | 5% | 2 | 2.2E−03 | 7.3E−04 | 32% | 2 |
| R326M | R143M | 14.1 | 0.6 | 4% | 2 | 3.3E−03 | 3.0E−04 | 9% | 2 |

TABLE 18-continued

Calculated $k_{cat}$ of FXa Mutants

| Mutation (Mature FX Numbering) | Mutation (Chymotrypsin Numbering) | FVa Present | | | | No FVa | | | |
|---|---|---|---|---|---|---|---|---|---|
| | | $k_{cat}$ (s$^{-1}$) | ±S.D. (s$^{-1}$) | % CV | n | $k_{cat}$ (s$^{-1}$) | ±S.D. (s$^{-1}$) | % CV | n |
| R326K | R143K | 14.7 | 1.2 | 8% | 2 | 9.7E-04 | 4.7E-05 | 5% | 2 |
| R326Y | R143Y | 22.3 | 3.5 | 16% | 2 | 4.7E-03 | 1.5E-03 | 31% | 2 |
| T327A | T144A | 33.9 | 4.4 | 13% | 2 | 2.8E-03 | 7.2E-04 | 26% | 2 |
| T327L | T144L | 35.2 | 5.4 | 15% | 3 | 4.4E-03 | 4.3E-04 | 10% | 2 |
| S334A | S152A | 25.9 | 1.8 | 7% | 2 | 2.4E-03 | 5.3E-04 | 22% | 2 |
| S334T | S152T | 33.2 | 1.5 | 4% | 2 | 2.3E-03 | 8.6E-04 | 37% | 2 |
| S334N | S152N | 29.7 | 0.2 | 1% | 2 | 1.6E-03 | 3.1E-04 | 20% | 2 |
| R336E | R154E | 33.4 | 6.5 | 20% | 3 | 4.6E-03 | 9.9E-04 | 22% | 2 |
| K338A | K156A | 35.6 | 6.9 | 19% | 5 | 7.6E-04 | 3.6E-04 | 48% | 4 |
| K338S | K156S | 31.8 | 5.3 | 17% | 5 | 4.6E-03 | 2.3E-04 | 50% | 4 |
| K338N | K156N | 31.3 | 5.3 | 17% | 3 | 2.7E-03 | 5.8E-04 | 21% | 2 |
| K338R | K156R | 41.2 | 0.6 | 1% | 2 | 6.5E-03 | 4.4E-03 | 68% | 2 |
| K338V | K156V | 34.2 | 3.5 | 10% | 2 | 9.7E-04 | 3.9E-05 | 4% | 2 |
| K338Y | K156Y | 47.7 | 8.3 | 17% | 2 | 1.6E-03 | 1.9E-04 | 12% | 2 |
| K338M | K156M | 53.6 | 12.2 | 23% | 2 | 7.2E-03 | 3.2E-03 | 44% | 2 |
| T327A/K338A | T144A/K156A | 45.0 | 3.8 | 8% | 2 | 2.6E-04 | 3.9E-07 | 0% | 2 |
| T327L/K338M | T144L/K156M | 28.3 | 1.7 | 6% | 2 | 6.5E-03 | 5.2E-04 | 8% | 2 |
| E200V/T327L/K338M | E21V/T144L/K156M | 37.9 | 1.5 | 4% | 2 | 4.1E-03 | 3.1E-04 | 7% | 2 |
| E200V/T327L/S334A/K338M | E21V/T144L/S152A/K156M | 20.6 | 2.6 | 12% | 2 | 6.1E-04 | 3.3E-05 | 5% | 2 |
| V196S/G197A | V17S/G18A | No Activity | n.d. | n.d. | 0 | No Activity | n.d. | n.d. | 0 |
| V196S/L211S/G219H | V17S/L32S/G40H | 12.6 | 1.8 | 15% | 11 | 1.7E-05 | 3.0E-06 | 17% | 2 |
| D119N/G121S/V196S/ L211S/G219H | D[119]N/G[121]S/V17S/ L32S/G40H | 14.6 | 2.0 | 14% | 2 | 1.4E-05 | 3.7E-06 | 27% | 2 |
| G114N/V196S/L211S/G219H | G[114]N/V17S/L32S/G40H | 12.9 | 3.0 | 23% | 2 | 1.3E-05 | 2.2E-06 | 17% | 2 |
| GI 14N/D119N/G121SN196S/ L211S/G219H | G[114]N/D[119]N/G[121]S/ V17S/L32S/G40H | 13.4 | 5.5 | 41% | 3 | 1.0E-05 | 2.5E-06 | 25% | 4 |
| G197A/L211S/G2 1 9H | G18A/L32S/G40H | 12.5 | 2.1 | 17% | 2 | 2.1E-04 | 3.9E-05 | 19% | |
| V196S/G197A/L211S/G219H | V17S/G18A/L32S/G40H | No Activity | n.d. | n.d. | 0 | No Activity | n.d. | n.d. | 0 |
| I195L/V196S | I16L/V17S | No Activity | n.d. | n.d. | 0 | No Activity | n.d. | n.d. | 0 |
| I195L/G197A | I16L/G18A | No Activity | n.d. | n.d. | 0 | No Activity | n.d. | n.d. | 0 |
| I195L/L211S/G219H | I16L/L32S/G40H | 31.3 | 10.7 | 34% | 4 | 1.9E-04 | 1.2E-04 | 62% | 5 |
| V196S/N214D | V17S/N35D | 13.4 | 2.1 | 16% | 3 | 3.6E-05 | 5.1E-06 | 14% | 2 |
| V196S/N214A | V17S/N35A | 17.2 | 0.2 | 1% | 2 | 3.8E-05 | 3.7E-06 | 10% | 2 |
| V196S/N214S | V17S/N35S | 22.8 | 0.5 | 2% | 2 | 5.6E-05 | 5.9E-06 | 11% | 2 |
| V196S/E216R | V17S/E37R | 13.4 | 2.9 | 22% | 3 | 4.6E-05 | 1.2E-05 | 25% | 2 |
| V196S/E216K | V17S/E37K | 20.7 | 1.2 | 6% | 2 | 4.2E-05 | 4.2E-06 | 10% | 2 |
| V196S/E216A | V17S/E37A | 14.7 | 1.1 | 7% | 2 | 3.7E-05 | 1.4E-05 | 37% | 2 |
| V196S/E216S | V17S/E37S | 15.4 | 4.2 | 28% | 2 | 3.0E-05 | 1.2E-05 | 41% | 2 |
| V196S/E218R | V17S/E39R | 12.3 | 3.4 | 28% | 3 | 4.3E-05 | 4.6E-06 | 11% | 2 |
| V1 96S/E218K | V17S/E39K | 14.6 | 4.4 | 30% | 2 | 3.3E-05 | 1.1E-05 | 34% | 2 |
| V196S/E218A | V17S/E39A | 19.7 | 8.1 | 41% | 2 | 3.9E-05 | 9.3E-06 | 24% | 2 |
| V196S/R332A | V17S/R150A | 23.3 | 4.9 | 21% | 4 | 8.3E-05 | 3.3E-05 | 40% | 3 |
| V196S/R332D | V17S/R150D | 41.6 | 35.7 | 86% | 5 | 2.4E-05 | 2.5E-06 | 10% | 5 |
| V196S/R332E | V17S/R150E | 19.3 | 5.2 | 27% | 2 | 5.4E-05 | 1.5E-05 | 28% | 2 |
| V196S/R332S | V17S/R150S | 23.0 | 11.2 | 49% | 6 | 2.1E-05 | 3.6E-06 | 17% | 5 |
| V196S/R332G | V17S/R150G | 20.8 | 9.7 | 47% | 5 | 1.6E-05 | 3.2E-06 | 20% | 4 |
| V196S/R326E | V17S/R143E | No Activity | n.d. | n.d. | 0 | No Activity | n.d. | n.d. | 0 |
| V196S/R326D | V17S/R143D | 2.3 | 1.0 | 44% | 5 | 6.9E-06 | 1.7E-06 | 25% | 2 |
| V196S/R326M | V17S/R143M | 9.1 | 0.5 | 5% | 2 | 5.8E-06 | 2.1E-06 | 35% | 2 |
| V196S/R326N | V17S/R143N | 6.2 | 0.7 | 10% | 3 | 4.8E-06 | 1.6E-06 | 34% | 2 |
| V196S/R326Q | V17S/R143Q | 6.5 | 1.3 | 21% | 12 | 6.8E-06 | 6.8E-06 | 100% | 3 |
| V 196S/R273E | V17S/R93E | 19.5 | 4.8 | 25% | 3 | 3.9E-05 | 1.0E-05 | 26% | 2 |
| V196S/R273A | V17S/R93A | 16.7 | 0.2 | 1% | 2 | 2.7E-05 | 4.1E-06 | 15% | 2 |
| V196S/R424A | V17S/R240A | 17.6 | 3.1 | 18% | 2 | 2.9E-05 | 1.6E-05 | 55% | 2 |
| V196S/R424E | V17S/R240E | 16.3 | 3.6 | 22% | 7 | 2.5E-05 | 1.0E-05 | 40% | 2 |
| V196S/K420A | V17S/K236A | 15.6 | 6.1 | 39% | 2 | 2.7E-05 | 1.1E-06 | 4% | 2 |
| V196S/K420E | V17S/K236E | 10.6 | 1.0 | 10% | 2 | 2.4E-05 | 6.3E-06 | 27% | 2 |
| V196S/R306E | V17S/R125A | 14.8 | 2.8 | 19% | 2 | 2.1E-05 | n.d. | n.d. | 1 |
| V196S/K276A | V17S/K96A | 9.1 | 2.0 | 22% | 2 | 1.7E-05 | 3.0E-06 | 18% | 2 |
| V196S/K276E | V17S/K96E | 6.4 | 1.8 | 28% | 2 | 1.0E-05 | 2.5E-06 | 24% | 2 |
| V196S/K420E/R424E | V17S/K236E/R240E | 5.1 | 3.3 | 65% | 3 | 2.6E-05 | 1.3E-05 | 49% | 2 |
| V196S/R273E/K420E/R424E | V17S/R93E/K236E/R240E | No Activity | n.d. | n.d. | 0 | No Activity | n.d. | n.d. | 0 |
| V196S/R273E/R306E/K420E/ R424E | V17S/R93E/R125E/K236E/ R240E | No Activity | n.d. | n.d. | 0 | No Activity | n.d. | n.d. | 0 |
| V196S/K338A | V17S/K156A | 1.9 | 0.3 | 14% | 2 | 3.0E-06 | 8.5E-07 | 28% | 2 |
| V196S/K338S | V17S/K156S | 2.5 | 0.8 | 33% | 10 | 8.9E-06 | 3.8E-06 | 42% | 8 |
| V196S/E215N/N217S | V17S/E36N/N38S | 24.9 | 3.7 | 15% | 3 | 9.4E-05 | 5.4E-05 | 58% | 4 |
| V196S/E264N/E266S | V17S/E84N/E86S | 27.6 | 7.9 | 28% | 4 | 7.1E-05 | 3.5E-05 | 50% | 4 |
| D119N/G121S/V196S/E264N/ E266S | D[119]N/G[121]S/V17S/E84N/ E86S | 12.6 | 10.9 | 87% | 2 | 3.0E-05 | 1.2E-05 | 42% | 2 |
| G114N/V196S/E264N/E266S | G[114]N/V17S/E84N/E86S | 23.2 | 0.0 | 0% | 2 | 2.0E-05 | 1.7E-06 | 9% | 2 |
| V196S/R429N/L431S | V17S/R245N/L247S | 25.0 | 8.1 | 32% | 2 | 4.1E-05 | 6.7E-06 | 16% | 2 |
| V196S/R243N/K245S | V17S/R63N/K65S | 5.1 | 1.7 | 34% | 3 | 6.1E-05 | 4.9E-05 | 81% | 2 |

TABLE 18-continued

Calculated $k_{cat}$ of FXa Mutants

| | | FVa Present | | | | No FVa | | | |
|---|---|---|---|---|---|---|---|---|---|
| Mutation (Mature FX Numbering) | Mutation (Chymotrypsin Numbering) | $k_{cat}$ ($s^{-1}$) | ±S.D. ($s^{-1}$) | % CV | n | $k_{cat}$ ($s^{-1}$) | ±S.D. ($s^{-1}$) | % CV | n |
| V196S/T293N/R295S | V17S/T113N/R115S | 23.1 | 9.4 | 40% | 2 | 7.7E−05 | 1.6E−05 | 20% | 2 |
| V196S/D389N/Y391S | V17S/D205N/Y207S | 8.5 | 2.8 | 34% | 2 | 1.1E−04 | 5.3E−05 | 47% | 3 |
| V196S/K388N | V17S/K204N | 24.3 | 6.9 | 28% | 5 | 1.4E−04 | 9.8E−05 | 73% | 4 |
| D119N/G121S/V196S/K388N | D[119]N/G[121]S/V17S/K204N | 24.0 | 0.3 | 1% | 2 | 1.7E−05 | 6.4E−06 | 38% | 2 |
| V196S/T428N/G430S | V17S/T244N/G246S | 21.0 | 2.4 | 11% | 2 | 8.2E−05 | 3.5E−06 | 4% | 2 |
| V196S/L211S/G219H/E264N/E266S | V17S/L32S/G40H/E84N/E86S | 13.1 | 5.1 | 39% | 3 | 1.9E−05 | 8.8E−06 | 46% | 2 |
| D119N/G121S/V196S/L211S/G219H/E264N/E266S | D[119]N/G[121]S/V17S/L32S/G40H/E84N/E86S | 13.8 | 2.7 | 20% | 2 | 1.8E−05 | 1.4E−05 | 76% | 2 |
| G114N/V196S/L211S/G219H/E264N/E266S | G[114]N/V17S/L32S/G40H/E84N/E86S | 15.4 | 6.8 | 44% | 4 | 8.4E−06 | 3.9E−06 | 47% | 2 |
| V196S/E264N/E266S/K388N | V17S/E84N/E86S/K204N | 17.2 | 2.3 | 14% | 2 | 1.0E−05 | 6.0E−06 | 59% | 2 |
| D119N/G121S/V196S/L211S/G219H/K388N | D[119]N/G[121]S/V17S/L32S/G40H/K204N | 7.7 | 2.1 | 27% | 3 | 9.0E−06 | 5.2E−06 | 58% | 2 |
| G114N/V196S/L211S/G219H/K388N | G[114]N/V17S/L32S/G40H/K204N | 24.3 | 19.3 | 79% | 4 | 8.3E−06 | 5.9E−06 | 71% | 2 |
| V196S/L211S/G219H/E264N/E266S/K388N | V17S/L32S/G40H/E84N/E86S/K204N | 10.4 | 1.1 | 11% | 2 | 1.9E−05 | 1.4E−05 | 70% | 2 |

TABLE 19

Calculated Specificity Constant ($k_{cat}$/KM) and Relative Cofactor Dependence of FXa variants

| | | FVa-Dependent Catalytic Activity (FVa Present) | | | | | FVa-Independent Catalytic Activity (No FVa) | | | | | |
|---|---|---|---|---|---|---|---|---|---|---|---|---|
| Mutation (Mature FX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n | $k_{cat}/K_M$ ($M^{-1}s^{-1}$) | ±S.D. ($M^{-1}s^{-1}$) | % CV | % of WT $k_{cat}/K_M$ | n | Relative Cofactor Dependence |
| Plasma FXa | Plasma FXa | 3.3E+08 | 1.1E+08 | 34% | 129% | 120 | 1.1E+05 | 4.5E+04 | 40% | 151% | 100 | 2,941 |
| FXa WT | FXa WT | 2.6E+08 | 1.1E+08 | 42% | 100% | 38 | 7.5E+04 | 3.0E+04 | 40% | 100% | 16 | 3,427 |
| I195L | I16L | 3.2E+08 | 8.3E+07 | 26% | 126% | 28 | 2.3E+03 | 9.6E+02 | 41% | 3% | 10 | 138,730 |
| V196I | V17I | 2.2E+08 | 3.1E+07 | 14% | 85% | 2 | 2.2E+04 | 1.1E+03 | 5% | 29% | 2 | 9,857 |
| V196S | V17S | 4.2E+08 | 1.5E+08 | 36% | 163% | 47 | 2.2E+02 | 1.2E+02 | 56% | 0.3% | 25 | 1,949,704 |
| T85N/K87S/V196S | T[85]N/K[87]S/V17S | 9.7E+07 | 1.2E+07 | 12% | 38% | 3 | 1.2E+02 | 5.0E+01 | 41% | 0.2% | 3 | 796,199 |
| Q56N/Q58S/V196S | Q[56]N/Q[58]S/V17S | 2.8E+08 | 2.7E+07 | 10% | 109% | 3 | 1.7E+02 | 6.6E+01 | 40% | 0.2% | 3 | 1,689,225 |
| K62N/G64S/V196S | K[62]N/G[64]S/V17S | 3.9E+08 | 5.8E+07 | 15% | 153% | 2 | 2.0E+02 | 6.1E+01 | 30% | 0.3% | 3 | 1,954,206 |
| L65N/E67S/V196S | L[65]N/E[67]S/V17S | 4.5E+08 | 5.2E+07 | 11% | 176% | 2 | 1.6E+02 | 6.3E+01 | 39% | 0.2% | 3 | 2,783,973 |
| E67N/V196S | E[67]N/V17S | 2.6E+08 | 8.4E+07 | 32% | 101% | 3 | 1.0E+02 | 2.3E+00 | 2% | 0.1% | 2 | 2,577,649 |
| L73N/G75S/V196S | L[73]N/G[75]S/V17S | 1.7E+08 | 7.6E+07 | 44% | 67% | 3 | 1.1E+02 | 2.4E+01 | 22% | 0.1% | 3 | 1,622,299 |
| G75N/E77S/V196S | G[75]N/E[77]S/V17S | 2.6E+08 | 1.5E+08 | 58% | 99% | 3 | 2.0E+02 | 5.1E+01 | 25% | 0.3% | 3 | 1,260,991 |
| R86N/L88S/V196S | R[86]N/L[88]S/V17S | 2.9E+08 | 1.3E+08 | 44% | 113% | 3 | 7.2E+02 | 1.9E+02 | 26% | 1% | 3 | 404,779 |
| G114N/V196S | G[114]N/V17S | 2.0E+08 | 6.1E+07 | 31% | 77% | 6 | 1.1E+02 | 3.2E+01 | 28% | 0.2% | 4 | 1,720,332 |
| D95N/D97S/V196S | D[95]N/D[97]S/V17S | 2.7E+08 | 1.0E+08 | 38% | 106% | 4 | 1.7E+01 | 5.5E+00 | 32% | 0.0% | 4 | 15,813,111 |
| E82S/V196S | E[82]S/V17S | 1.5E+08 | 9.5E+07 | 61% | 60% | 9 | 1.1E+02 | 6.1E+01 | 56% | 0.1% | 10 | 1,414,270 |
| E82N/F84S/V196S | E[82]N/F[84]S/V17S | 2.2E+08 | 7.5E+07 | 34% | 87% | 2 | 4.8E+01 | 1.6E+01 | 33% | 0.1% | 5 | 4,676,971 |
| G78N/N80S/V196S | G[78]N/N[80]S/V17S | 1.3E+08 | 5.7E+07 | 45% | 49% | 4 | 5.8E+01 | 3.7E+01 | 64% | 0.1% | 5 | 2,180,187 |
| E77N/K79S/V196S | E[77]N/K[79]S/V17S | 1.5E+08 | 8.3E+07 | 57% | 57% | 4 | 7.7E+01 | 1.9E+01 | 25% | 0.1% | 4 | 1,913,457 |
| D119N/G121S/V196S | D[119]N/G[121]S/V17S | 2.1E+08 | 5.2E+07 | 25% | 80% | 4 | 6.2E+01 | 1.4E+01 | 23% | 0.1% | 4 | 3,348,627 |
| L83N/V196S | L[83]N/V17S | 1.5E+08 | 3.8E+07 | 25% | 59% | 4 | 1.2E+02 | 4.5E+01 | 37% | 0.2% | 3 | 1,261,176 |
| K122S/V196S | K[122]S/V17S | 1.4E+08 | 1.9E+07 | 13% | 55% | 6 | 6.5E+01 | 2.5E+01 | 39% | 0.1% | 5 | 2,200,872 |
| E51N/V196S | E[51]N/V17S | 2.3E+08 | 2.0E+07 | 9% | 88% | 2 | 1.2E+02 | 1.2E+01 | 10% | 0.2% | 2 | 1,858,168 |
| Q58N/K60S/V196S | Q[58]N/K[60]S/V17S | 2.3E+08 | 4.1E+07 | 18% | 90% | 2 | 1.0E+02 | 6.3E+00 | 6% | 0.1% | 2 | 2,265,746 |
| G114N/D119N/G121S/V196S | G[114]N/D[119]N/G[121]S/V17S | 3.2E+08 | 4.1E+07 | 13% | 125% | 4 | 1.1E+02 | 5.4E+01 | 51% | 0.1% | 4 | 3,062,135 |

TABLE 19-continued

Calculated Specificity Constant ($k_{cat}/K_M$) and Relative Cofactor Dependence of FXa variants

| Mutation (Mature FX Numbering) | Mutation (Chymotrypsin Numbering) | FVa-Dependent Catalytic Activity (FVa Present) | | | | | FVa-Independent Catalytic Activity (No FVa) | | | | | Relative Cofactor Dependence |
|---|---|---|---|---|---|---|---|---|---|---|---|---|
| | | $k_{cat}/K_M$ ($M^{-1}s^{-1}$) | ±S.D. ($M^{-1}s^{-1}$) | % CV | % of WT $k_{cat}/K_M$ | n | $k_{cat}/K_M$ ($M^{-1}s^{-1}$) | ±S.D. ($M^{-1}s^{-1}$) | % CV | % of WT $k_{cat}/K_M$ | n | |
| G198A | G19A | No Activity | n.d. | n.d. | 0% | 0 | No Activity | n.d. | n.d. | n.d. | 0 | n.d. |
| G198V | G19V | No Activity | n.d. | n.d. | 0% | 0 | No Activity | n.d. | n.d. | n.d. | 0 | n.d. |
| G198R | G19R | No Activity | n.d. | n.d. | 0% | 0 | No Activity | n.d. | n.d. | n.d. | 0 | n.d. |
| G198K | G19K | No Activity | n.d. | n.d. | 0% | 0 | No Activity | n.d. | n.d. | n.d. | 0 | n.d. |
| G198P | G19P | No Activity | n.d. | n.d. | 0% | 0 | No Activity | n.d. | n.d. | n.d. | 0 | n.d. |
| G198H | G19H | No Activity | n.d. | n.d. | 0% | 0 | No Activity | n.d. | n.d. | n.d. | 0 | n.d. |
| L211S/G219H | L32S/G40H | 4.3E+08 | 4.1E+07 | 10% | 168% | 2 | 6.2E+04 | 4.6E+03 | 7% | 83% | 2 | 6,920 |
| G197P | G18P | No Activity | n.d. | n.d. | 0% | 0 | No Activity | n.d. | n.d. | n.d. | 0 | n.d. |
| D378N | D194N | No Activity | n.d. | n.d. | 0% | No | n.d. | n.d. | n.d. | 0 | n.d. | |
| D378S | D194S | No Activity | n.d. | n.d. | 0% | 0 | No Activity | n.d. | n.d. | n.d. | 0 | n.d. |
| V196L | V17L | 3.7E+08 | 8.6E+07 | 23% | 145% | 2 | 8.4E+03 | 1.8E+03 | 22% | 11% | 2 | 44,694 |
| V196T | V17T | 3.4E+08 | 1.0E+08 | 30% | 134% | 2 | 2.0E+03 | 2.4E+02 | 12% | 3% | 2 | 172,484 |
| V196P | V17P | No Activity | n.d. | n.d. | 0% | 0 | No Activity | n.d. | n.d. | n.d. | 0 | n.d. |
| G197V | G18V | No Activity | n.d. | n.d. | 0% | 0 | No Activity | n.d. | n.d. | n.d. | 0 | n.d. |
| G197T | G18T | No Activity | n.d. | n.d. | 0% | 0 | No Activity | n.d. | n.d. | n.d. | 0 | n.d. |
| G197S | G18S | 2.0E+08 | 8.4E+06 | 4% | 78% | 2 | 1.0E+03 | 1.5E+02 | 15% | 1% | 2 | 198,192 |
| E200A | E21A | 2.5E+08 | 4.6E+07 | 18% | 98% | 2 | 9.5E+03 | 2.1E+03 | 22% | 13% | 2 | 26,489 |
| E200S | E21S | 1.1E+08 | 2.7E+05 | 0% | 44% | 2 | 2.3E+04 | 2.4E+03 | 10% | 31% | 2 | 4,796 |
| E200V | E21V | 2.4E+08 | 3.1E+07 | 13% | 92% | 2 | 1.3E+04 | 9.5E+02 | 7% | 17% | 2 | 18,368 |
| K202S | K23S | 3.7E+08 | 2.1E+07 | 6% | 144% | 2 | 1.1E+04 | 2.2E+03 | 20% | 14% | 2 | 34,688 |
| R326A | R143A | 1.6E+08 | 1.3E+07 | 8% | 64% | 2 | 4.3E+04 | 2.5E+03 | 6% | 57% | 2 | 3,817 |
| R326S | R143S | 1.7E+08 | 1.3E+06 | 1% | 66% | 2 | 2.1E+04 | 5.1E+03 | 25% | 28% | 2 | 8,216 |
| R326T | R143T | 2.1E+08 | 2.6E+06 | 1% | 80% | 2 | 1.7E+04 | 5.0E+03 | 29% | 23% | 2 | 11,901 |
| R326V | R143V | 4.5E+08 | 1.3E+08 | 29% | 176% | 2 | 2.4E+04 | 2.5E+03 | 10% | 32% | 2 | 18,752 |
| R326Q | R143Q | 2.4E+08 | 3.3E+07 | 14% | 93% | 2 | 1.2E+04 | 3.9E+03 | 33% | 16% | 2 | 19,958 |
| R326N | R143N | 2.3E+08 | 3.5E+06 | 2% | 89% | 2 | 1.8E+04 | 5.7E+03 | 31% | 24% | 2 | 12,662 |
| R326M | R143M | 1.8E+08 | 4.6E+06 | 3% | 70% | 2 | 2.0E+04 | 6.4E+03 | 32% | 26% | 2 | 9,107 |
| R326K | R143K | 1.3E+08 | 1.2E+07 | 9% | 50% | 2 | 6.2E+03 | 9.6E+02 | 16% | 8% | 2 | 20,886 |
| R326Y | R143Y | 3.3E+08 | 1.9E+07 | 6% | 128% | 2 | 3.2E+04 | 3.4E+03 | 11% | 43% | 2 | 10,164 |
| T327A | T144A | 2.9E+08 | 2.4E+07 | 8% | 114% | 2 | 1.7E+04 | 1.7E+03 | 10% | 22% | 2 | 17,524 |
| T327L | T144L | 2.9E+08 | 1.1E+08 | 37% | 114% | 3 | 2.4E+04 | 9.0E+03 | 37% | 32% | 2 | 12,215 |
| S334A | S152A | 2.3E+08 | 5.1E+07 | 22% | 89% | 2 | 1.7E+04 | 4.0E+03 | 24% | 22% | 2 | 13,610 |
| S334T | S152T | 3.2E+08 | 8.7E+07 | 27% | 125% | 2 | 1.6E+04 | 1.1E+04 | 65% | 22% | 2 | 19,693 |
| S334N | S152N | 3.2E+08 | 7.3E+07 | 23% | 124% | 2 | 1.0E+04 | 1.8E+03 | 17% | 14% | 2 | 31,084 |
| R336E | R154E | 3.2E+08 | 8.4E+07 | 26% | 126% | 3 | 2.9E+04 | 1.0E+03 | 3% | 39% | 2 | 11,104 |
| K338A | K156A | 3.6E+08 | 4.2E+07 | 12% | 139% | 5 | 4.4E+03 | 1.8E+03 | 41% | 6% | 4 | 80,902 |
| K338S | K156S | 2.9E+08 | 4.5E+07 | 15% | 114% | 5 | 2.7E+03 | 1.1E+03 | 41% | 4% | 4 | 109,860 |
| K338N | K156N | 2.9E+08 | 5.5E+07 | 19% | 111% | 3 | 1.8E+04 | 3.1E+03 | 18% | 24% | 2 | 16,112 |
| K338R | K156R | 3.7E+08 | 7.9E+06 | 2% | 143% | 2 | 3.3E+04 | 1.4E+04 | 42% | 45% | 2 | 10,973 |
| K338V | K156V | 3.9E+08 | 6.7E+07 | 17% | 151% | 2 | 6.3E+03 | 1.6E+03 | 26% | 8% | 2 | 61,833 |
| K338Y | K156Y | 3.1E+08 | 5.4E+07 | 17% | 122% | 2 | 9.7E+03 | 9.1E+02 | 9% | 13% | 2 | 32,379 |
| K338M | K156M | 3.0E+08 | 2.4E+07 | 8% | 115% | 2 | 3.9E+04 | 1.2E+04 | 30% | 52% | 2 | 7,576 |
| T327A/K338A | T144A/K156A | 2.4E+08 | 5.3E+06 | 2% | 93% | 2 | 1.0E+03 | 1.9E+02 | 18% | 1% | 2 | 231,251 |
| T327L/K338M | T144L/K156M | 1.9E+08 | 2.3E+06 | 1% | 73% | 2 | 3.8E+04 | 2.9E+03 | 8% | 50% | 2 | 4,966 |
| E200V/T327L/ K338M | E21V/T144L/ K156M | 3.0E+08 | 1.1E+07 | 4% | 117% | 2 | 2.5E+04 | 3.3E+03 | 13% | 34% | 2 | 11,872 |
| E200V/T327L/ S334A/ K338M | E21V/T144L/ S152A/ K156M | 2.9E+08 | 6.1E+06 | 2% | 114% | 2 | 3.6E+03 | 5.5E+01 | 2% | 5% | 2 | 82,667 |
| V196S/G197A | V17S/G18A | No Activity | n.d. | n.d. | 0% | 0 | No Activity | n.d. | n.d. | n.d. | 0 | n.d. |
| V196S/L211S/ G219H | V17S/L32S/ G40H | 2.7E+08 | 7.0E+07 | 26% | 107% | 11 | 1.5E+02 | 9.9E+00 | 7% | 0.2% | 2 | 1,825,614 |
| D119N/G121S/ V196S/L211S/ G219H | D[119]N/ G[121]S/V17S/ L32S/G40H | 4.0E+08 | 1.8E+08 | 44% | 156% | 2 | 1.7E+02 | 1.2E+02 | 73% | 0.2% | 2 | 2,424,835 |
| G114N/V196S/ L211S/G219H | G[114]N/V17S/ L32S/G40H | 3.7E+08 | 8.9E+07 | 24% | 143% | 2 | 1.8E+02 | 8.0E+01 | 43% | 0.2% | 2 | 1,991,946 |

TABLE 19-continued

Calculated Specificity Constant ($k_{cat}/K_M$) and Relative Cofactor Dependence of FXa variants

| Mutation (Mature FX Numbering) | Mutation (Chymotrypsin Numbering) | FVa-Dependent Catalytic Activity (FVa Present) | | | | | FVa-Independent Catalytic Activity (No FVa) | | | | | Relative Cofactor Dependence |
|---|---|---|---|---|---|---|---|---|---|---|---|---|
| | | $k_{cat}/K_M$ (M$^{-1}$s$^{-1}$) | ±S.D. (M$^{-1}$s$^{-1}$) | % CV | % of WT $k_{cat}/K_M$ | n | $k_{cat}/K_M$ (M$^{-1}$s$^{-1}$) | ±S.D. (M$^{-1}$s$^{-1}$) | % CV | % of WT $k_{cat}/K_M$ | n | |
| G114N/D119N/G121S/V196S/L211S/G219H | G[114]N/D[119]N/G[121]S/V17S/L32S/G40H | 3.3E+08 | 2.4E+07 | 7% | 128% | 3 | 8.3E+01 | 2.4E+01 | 29% | 0.1% | 4 | 3,937,247 |
| G197A/L211S/G219H | G18A/L32S/G40H | 1.3E+08 | 1.8E+07 | 13% | 52% | 2 | 1.9E+03 | 7.0E+02 | 37% | 3% | 3 | 69,315 |
| V196S/G197A/L211S/G219H | V17S/G18A/L32S/G40H | No Activity | n.d. | n.d. | 0% | 0 | No TABLE 19-continued Calculated Specificity Constant ($k_{cat}$/KM) and Relative Cofactor Dependence of FXa variants

| Mutation (Mature FX Numbering) | Mutation (Chymotrypsin Numbering) | FVa-Dependent Catalytic Activity (FVa Present) | | | | | FVa-Independent Catalytic Activity (No FVa) | | | | | Relative Cofactor Dependence |
|---|---|---|---|---|---|---|---|---|---|---|---|---|
| | | $k_{cat}/K_M$ ($M^{-1}s^{-1}$) | ±S.D. ($M^{-1}s^{-1}$) | % CV | % of WT $k_{cat}/K_M$ | n | $k_{cat}/K_M$ ($M^{-1}s^{-1}$) | ±S.D. ($M^{-1}s^{-1}$) | % CV | % of WT $k_{cat}/K_M$ | n | |
| D119N/G121S/ V196S/K388N | D[119]N/ G[121]S/ V7S/K204N | 4.3E+08 | 1.8E+08 | 42% | 167% | 2 | 2.6E+02 | 4.4E+01 | 17% | 0.3% | 2 | 1,661,646 |
| V196S/T428N/ G430S | V17S/T244N/ G246S | 2.5E+08 | 9.4E+07 | 38% | 97% | 2 | 9.8E+01 | 3.2E+00 | 3% | 0.1% | 2 | 2,555,985 |
| V196S/L211S/ G219H/ E264N/E266S | V17S/L32S/ G40H/ E84N/E86S | 4.2E+08 | 6.7E+07 | 16% | 163% | 3 | 1.1E+02 | 2.2E+01 | 20% | 0.2% | 2 | 3,707,889 |
| D119N/G121S/ V196S/L211S/ G219H/E264N/ E266S | D[119]N/ G[121]S/V17S/ L32S/G40H/ E84N/E86S | 3.4E+08 | 9.6E+05 | 0% | 132% | 2 | 2.3E+02 | 1.3E+02 | 56% | 0.3% | 2 | 1,486,131 |
| G114N/V196S/ L211S/G219H/ E264N/E266S | G[114]N/V17S/ L32S/G40H/ E84N/E86S | 2.5E+08 | 7.7E+07 | 30% | 98% | 4 | 1.2E+02 | 7.8E+01 | 66% | 0.2% | 2 | 2,147,579 |
| V196S/E264N/ E266S/K388N | V17S/E84N/ E86S/K204N | 3.3E+08 | 2.2E+08 | 67% | 128% | 2 | 1.7E+02 | 1.3E+02 | 76% | 0.2% | 2 | 1,969,113 |
| D119N/G121S/ V196S/ L211S/G219H/ K388N | D[119]N/ G[121]S/V17S/ L32S/G40H/ K204N | 1.5E+08 | 9.1E+07 | 59% | 60% | 3 | 1.3E+02 | 3.4E+01 | 27% | 0.2% | 2 | 1,218,354 |
| G114N/V196S/ L211S/ G219H/K388N | G[114]N/V17S/ L32S/ G40H/K204N | 2.4E+08 | 8.5E+07 | 35% | 94% | 4 | 1.1E+02 | 4.7E+01 | 44% | 0.1% | 2 | 2,222,421 |
| V196S/L211S/ G219H/E264N/ E266S/K388N | V17S/L32S/ G40H/E84N/ E86S/K204N | 1.4E+08 | 1.3E+07 | 9% | 54% | 2 | 1.7E+02 | 1.6E+02 | 92% | 0.2% | 2 | 823,652 |

Example 5

Determination of the Inhibition of FXa by the Antithrombin/Heparin Complex

Inhibition of wild-type FXa or FXa variants by the Antithrombin/heparin complex (AT/heparin) was assessed by measuring the level of inhibition by AT/heparin on the catalytic activity of FXa towards a small molecule substrate, $CH_3SO_2$-D-CHG-Gly-Arg-AMC (Pefafluor FXa; Centerchem). A $K_{0.5}$ value was determined for each FXa variant tested, which corresponds to the molar concentration of AT that was required for 50% inhibition ($IC_{50}$) of the catalytic activity of an FXa variant under the predefined conditions of the assay. Inhibition reactions were performed in the presence of full-length unfractionated heparin (UFH; Calbiochem), which increases the rate of the inhibition reaction due to the "templating" effect provided by longer heparin chains (see e.g., Olson et al. (2004) *Thromb Haemost* 92(5), 929-939). The apparent second-order rate constant ($k_{app}$) for the inhibition of wild-type FXa or FXa variants by the AT/UFH complex was also directly evaluated using a modified protocol, in which the time of incubation with the AT/UFH complex was varied.

A. Inhibition of FXa by the Antithrombin/UFH Complex

For inhibition reactions in the presence of UFH, 2× solutions of 2000 nM, 1000 nM, 200 nM, or 100 nM AT/UFH (final 2 μM UFH) were prepared by dilution of a 20 μM stock of plasma purified human AT-III (Molecular Innovations) into a solution of excess UFH (2 μM) in a 1.0 mL volume of 1× Buffer A (20 mM Hepes, 150 mM NaCl, 5 mM $CaCl_2$, 0.01% Tween-20, 0.1% PEG 8000, pH 7.4). AT/UFH solutions were incubated for 15 minutes at room temperature before being serially diluted 2-fold in a 96 deep-well polypropylene plate with a volume of 500 μL 1× Buffer A containing 2 μM UFH. The final dilutions of AT were dependent on the starting concentration of AT and ranged from 2000-0 nM, 1000-0 nM, 200-0 nM or 100-0 nM (i.e. rows A-H). Those variants, which showed increased resistance to AT inhibition under the standard conditions, were further tested using higher concentrations of AT. Aliquots of 35 μL of each AT dilution were dispensed into their respective rows of a 96-well V-bottom storage plate to fill all columns (i.e. 1-12). FXa variants were initially diluted to 100 nM in 1× Buffer A. Subsequently, 50 μL of each 100 nM FXa variant were diluted to a concentration of 2.0 nM in 2.5 mL of 1× Buffer A and then 70 μL of this solution were dispensed into a 96-well V-bottom storage plate according to the same predefined plate map (4 FXa variants per plate).

Assay reactions were initiated using a BioMek FX liquid handling system programmed to dispense 35 μL of the FXa solutions into the plates containing 35 μL of each dilution of AT/UFH per well for a total of two duplicate assay plates for each FXa variant. The final inhibition assay conditions were: 1.0 nM FXa and AT/UFH dilutions ranging from 35 nM to 0 nM, 50 nM to 0 nM, 100 nM to 0 nM, 500 nM to 0 nM or 1000 nM to 0 nM AT in 1 μM UFH.

Inhibition reactions were further incubated for 30 seconds at room temperature (~25° C.) before a 40 μL aliquot of the reaction was transferred by the BioMek FX to a 96-well black half-area plate containing 20 μL of 0.3 mM Pefafluor Xa in assay Buffer A supplemented with 15 mg/mL polybrene. To quench the AT/UFH reaction, polybrene (hexadimethrine bromide) at a final concentration of 5 mg/mL was added to the reaction. Residual activity of FXa was assessed by following the initial rates of substrate cleavage for 60 minutes in a fluorescence plate reader set to 25° C. The final assay conditions for determination of residual activity were 2.0 nM FXa variant, 0.1 mM Pefafluor FX and 5 mg/mL polybrene in Buffer A.

To determine the degree of inhibition by AT/UFH for FXa or FXa variants, raw data collected with the SoftMax Pro application (Molecular Devices) were exported as .TXT files. Further non-linear data analyses were performed directly within the ActivityBase software package using the XE Runner data analysis module (IDBS Software). The template was used to calculate the AT dilution series, ratio of AT to FXa, and the $V_i/V_0$ ratios for each FXa replicate at each experimental AT concentration. Non-linear regression analyses of residual FXa activity (expressed as $V_i/V_0$) versus AT concentration were processed using a hyperbolic inhibition equation of the form $[C+(Amp*(1-(X/(K_{0.5}+X))))]$; where C=the offset (fixed at 0 to permit extrapolation of data sets that did not reach 100% inhibition during the course of the assay), Amp=the amplitude of the fit and $K_{0.5}$, which corresponds to the concentration of AT required for half-maximal inhibition under the assay conditions.

For several FXa variants, AT/UFH inhibited less than 10-15% of the total protease activity at the highest tested concentration of AT, representing an upper limit of detection for the assay under standard screening conditions. Variants with less than 10% maximal inhibition were therefore assigned a lower limit $K_{0.5}$ value of 10000 nM and in most cases are expected to have AT resistances much greater than the reported value.

Table 20 provides the results of the assays that were performed with AT/UFH. The results are presented as the fitted $K_{0.5}$ parameter and as a representation of the extent of AT-III resistance for each variant compared to the wild-type FXa expressed as a ratio of their fitted $K_{0.5}$ values ($K_{0.5}$ variant/$K_{0.5}$ wild-type). The wild-type FXa polypeptide used for comparison was the recombinant wild-type FXa generated from in Examples 1-2.

Several FXa variants exhibited greater than 500-fold increased resistance to AT compared to wild-type FXa (FXa WT). For example, FXa-V196S/K276E, FXa-V196S/R332G, FXa-V196S/R332D, FXa-V196S/R326D, FXa-V196S/K338S, FXa-V196S/K420A and FXa-V196S/R424E are among the group that exhibited significant resistance to AT-III.

TABLE 20

Inhibition of FXa variants by AT-III/UFH

| Mutation (Mature FX Numbering) | Mutation (Chymotrypsin Numbering) | $K_{0.5}$ (nM) | ±S.D. (nM) | % CV | $K_{0.5\text{-}mut}/K_{0.5\text{-}wt}$ | n |
|---|---|---|---|---|---|---|
| Plasma FXa | Plasma FXa | 2 | 1 | 44% | 1 | 23 |
| FXa WT | FXa WT | 2 | 1 | 59% | 1 | 10 |
| I195L | I16L | 89 | 41 | 47% | 49 | 17 |
| V196I | V17I | 5 | 2 | 37% | 3 | 3 |
| V196S | V17S | 132 | 25 | 19% | 73 | 14 |
| L211S/G219H | L32S/G40H | 8 | 2 | 30% | 4 | 3 |
| V196L | V17L | 18 | 2 | 10% | 10 | 3 |
| V196T | V17T | 48 | 3 | 7% | 26 | 2 |
| G197S | G18S | 75 | 9 | 11% | 41 | 2 |
| E200A | E21A | 5 | 1 | 24% | 3 | 2 |
| E200S | E21S | 2 | 0 | 6% | 1 | 2 |
| E200V | E21V | 4 | 0 | 6% | 2 | 2 |
| K202S | K23S | 5 | 2 | 54% | 3 | 2 |
| R326A | R143A | 3 | 1 | 19% | 2 | 2 |
| R326S | R143S | 3 | 0 | 6% | 1 | 2 |
| R326T | R143T | 5 | 0 | 7% | 3 | 2 |
| R326V | R143V | 10 | 2 | 24% | 5 | 2 |
| R326Q | R143Q | 4 | 2 | 45% | 2 | 2 |
| R326N | R143N | 10 | 7 | 69% | 6 | 4 |

TABLE 20-continued

Inhibition of FXa variants by AT-III/UFH

| Mutation (Mature FX Numbering) | Mutation (Chymotrypsin Numbering) | $K_{0.5}$ (nM) | ±S.D. (nM) | % CV | $K_{0.5\text{-}mut}/K_{0.5\text{-}wt}$ | n |
|---|---|---|---|---|---|---|
| R326M | R143M | 7 | 3 | 43% | 4 | 4 |
| R326K | R143K | 6 | 1 | 14% | 3 | 2 |
| R326Y | R143Y | 6 | 1 | 11% | 3 | 2 |
| T327A | T144A | 5 | 1 | 13% | 3 | 2 |
| T327L | T144L | 5 | 2 | 33% | 3 | 2 |
| S334A | S152A | 12 | 8 | 69% | 7 | 2 |
| S334T | S152T | 19 | 9 | 45% | 11 | 2 |
| S334N | S152N | 8 | 0 | 4% | 4 | 2 |
| R336E | R154E | 5 | 0 | 6% | 3 | 2 |
| K338A | K156A | 23 | 3 | 13% | 13 | 4 |
| K338S | K156S | 34 | 8 | 24% | 19 | 4 |
| K338N | K156N | 8 | 1 | 19% | 4 | 2 |
| K338R | K156R | 6 | 1 | 24% | 3 | 2 |
| K338V | K156V | 52 | 2 | 4% | 29 | 2 |
| K338Y | K156Y | 7 | 0 | 6% | 4 | 2 |
| K338M | K156M | 4 | 1 | 25% | 2 | 2 |
| T327A/K338A | T144A/K156A | 42 | 3 | 8% | 23 | 2 |
| T327L/K338M | T144L/K156M | 5 | 1 | 27% | 3 | 2 |
| E200V/T327L/K338M | E21V/T144L/K156M | 8 | 2 | 27% | 4 | 2 |
| E200V/T327L/S334A/K338M | E21V/T144L/S152A/K156M | 40 | 13 | 31% | 22 | 2 |
| V196S/L211S/G219H | V17S/L32S/G40H | 194 | 35 | 18% | 108 | 4 |
| G197A/L211S/G219H | G18A/L32S/G40H | 128 | 43 | 34% | 71 | 4 |
| I195L/L211S/G219H | I16L/L32S/G40H | 180 | 29 | 16% | 100 | 4 |
| V196S/N214D | V17S/N35D | 154 | 18 | 12% | 86 | 2 |
| V196S/N214A | V17S/N35A | 185 | 107 | 58% | 103 | 2 |
| V196S/N214S | V17S/N35S | 186 | 7 | 4% | 103 | 2 |
| V196S/E216R | V 17S/E37R | 236 | 57 | 24% | 131 | 2 |
| V196S/E216K | V17S/E37K | 400 | 99 | 25% | 222 | 4 |
| V196S/E216A | V17S/E37A | 279 | 111 | 40% | 155 | 2 |
| V196S/E216S | V17S/E37S | 178 | 31 | 17% | 99 | 2 |
| V196S/E218R | V17S/E39R | 321 | 22 | 7% | 178 | 2 |
| V196S/E218K | V17S/E39K | 404 | 200 | 49% | 224 | 2 |
| V196S/E218A | V17S/E39A | 167 | 38 | 23% | 93 | 2 |
| V196S/R332A | V17S/R150A | 3757 | 2834 | 75% | 2085 | 4 |
| V196S/R332D | V17S/R150D | 7284 | 3841 | 53% | 4042 | 2 |
| V196S/R332E | V17S/R150E | 3961 | 2026 | 51% | 2198 | 4 |
| V196S/R332S | V17S/R150S | 7247 | 3345 | 46% | 4022 | 4 |
| V196S/R332G | V17S/R150G | 8357 | 3285 | 39% | 4638 | 4 |
| V196S/R326D | V17S/RI43D | 5455 | 3531 | 65% | 3027 | 2 |
| V196S/R326M | V17S/R143M | 850 | 286 | 34% | 472 | 4 |
| V196S/R326N | V17S/R143N | 1178 | 472 | 40% | 654 | 4 |
| V196S/R326Q | V17S/R143Q | 642 | 148 | 23% | 356 | 4 |
| V196S/R273E | V17S/R93E | 1491 | 923 | 62% | 828 | 2 |
| V196S/R273A | V17S/R93A | 1144 | 552 | 48% | 635 | 4 |
| V196S/R424A | V17S/R240A | 1756 | 811 | 46% | 975 | 4 |
| V196S/R424E | V17S/R240E | 3969 | 3725 | 94% | 2203 | 4 |
| V196S/K420A | V17 S/K236A | 10000 | 0 | 0% | 5550 | 3 |
| V196S/K420E | V17S/K236E | 10000 | 0 | 0% | 5550 | 3 |
| V196S/R306E | V17S/R125A | 10000 | 0 | 0% | 5550 | 3 |
| V196S/K276A | V17S/K96A | 7450 | 3606 | 48% | 4135 | 2 |
| V196S/K276E | V17S/K96E | 10000 | 0 | 0% | 5550 | 2 |
| V196S/K420E/R424E | V17S/K236E/R240E | 3019 | 1649 | 55% | 1675 | 4 |
| V196S/K338A | V17S/K156A | 1783 | 692 | 39% | 990 | 4 |
| V196S/K338S | V17S/K156S | 2260 | 975 | 43% | 1254 | 4 |

*A $K_{0.5}$ value of 10000 nM indicates the lower limit value for those variants with less than 10% inhibition under the conditions of the assay.

B. Determination of the Second-Order Rate Constant ($k_{app}$) for Inhibition of FXa by the Antithrombin/UFH Complex The second-order rate constant for inhibition ($k_{app}$) of FXa variants by AT/UFH were determined using the same assay as described above in Example 5A with minor modifications. The method used is more amenable to evaluating the second-order rate constants for multiple variants concurrently than competitive kinetic or discontinuous methods (see e.g., Olson et al. (2004) *Thromb Haemost* 92(5), 929-939).

For inhibition reactions in the presence of UFH, a 1000 nM solution of AT/UFH was prepared by dilution of a 20 µM stock of plasma purified human AT (Molecular Innovations) into a solution of excess UFH (2 µM) in a 1.0 mL volume of 1× Buffer A (20 mM Hepes, 150 mM NaCl, 5 mM CaCl$_2$, 0.01% Tween-20, 0.1% PEG 8000, pH 7.4). AT/UFH solutions were incubated for 15 minutes at room temperature prior to being serially diluted 2.0-fold in a column of a 96 deep-well polypropylene plate with a final volume of 500 µL 1× Buffer A containing 2 µM UFH. The final dilutions of AT-III for the modified $k_{app}$ assay ranged from 500 nM-0 nM (i.e. rows A-H). A total of 35 µL of each AT-III dilution was aliquoted into their respective rows of a 96-well V-bottom storage plate to fill all columns (i.e. 1-12). FXa variants were initially diluted to 100 nM in 1× Buffer A. Subsequently, 50 µl, of each 100 nM FXa variant was diluted to a concentration of 2.0 nM in 2.5 mL of 1× Buffer A and then 70 µL aliquots of this solution were dispensed into a 96-well V-bottom storage plate according to the same predefined plate map as above (4 FXa variants per plate).

Assay reactions were initiated using a BioMek FX liquid handling system programmed to dispense 35 µL of the FXa solutions into the plates containing 35 µL of each dilution of AT/UFH per well for a total of two duplicate assay plates for each FXa variant. The final inhibition assay conditions were: 1.0 nM FXa and AT dilutions ranging from 500 nM to 0 nM in 1 µM UFH so that the heparin remained in excess. Inhibition reactions were further incubated for various times at room temperature (~25° C.) depending on the expected inhibition rate constant and adjusted so that >90% inhibition could be reached at the highest concentration of AT in the assay (500 nM). Typical incubation times were determined specifically for each variant, or class of variants, but generally followed the incubation times outlined in Table 21.

TABLE 21

Assay Incubation Times Based on Expected $k_{app}$ Values

| Expected $k_{app}$ (M$^{-1}$s$^{-1}$) | FXa/ATIII Incubation (sec) |
|---|---|
| 1.0E−07 | 10 |
| 1.0E−06 | 30 |
| 1.0E−05 | 120 |
| 1.0E−04 | 600 |
| 1.0E−03 | 3600 |
| 1.0E−02 | 7200 |

Following the predetermined incubation time, a 40 µL aliquot of the reaction was transferred by the BioMek FX to a 96-well black half-area plate containing 20 µL of 0.3 mM Pefafluor Xa in assay Buffer A supplemented with 15 mg/mL polybrene. Polybrene (hexadimethrine bromide) at a final concentration of 5 mg/mL was added to Buffer A to quench the AT/UFH reaction. Residual activity of FXa was assessed by following the initial rates of substrate cleavage for 60 minutes in a fluorescence reader set to 25° C. The final assay conditions for determination of residual activity were 1.0 nM FXa variant, 0.1 mM Pefafluor Xa and 5 mg/mL polybrene in Buffer A. Data analyses to calculate the $K_{0.5}$ value were performed in a similar manner as that described above for AT/UFH inhibition assays in Example 5A using the ActivityBase software package and the XE Runner data analysis module (IDBS Software). Using the assay set-up outlined in Example 5A under psuedo-e-order conditions and testing various incubation times it was possible to calculate the apparent second-order rate constant for inhibition by AT ($k_{app}$) using the following equations:

$$k_{app} = \frac{k_{obs}}{\left(\frac{[AT]}{S.I.}\right)} \qquad \text{Equation (8)}$$

$$k_{obs} = \frac{\ln(2)}{t_{1/2}} \qquad \text{Equation (9)}$$

Since the fit value for $K_{0.5}$=[AT] at $t_{1/2}$ (defined by the time of the assay), all the necessary values are available to calculate $k_{obs}$ and thus $k_{app}$ for the inhibition of a given FXa variant by AT. The calculated $k_{app}$ value does not take into account any potential effects of changes in the stoichiometry of inhibition (S.I.), which was given a constant value of 1.2 in the present calculations as this value reflects what is typically reported in the literature (see e.g., Olson et al. (2004) *Thromb Haemost* 92(5), 929-939).

Table 22 provides the results of the second-order rate assays that were performed using AT/UFH. The results are presented both as the fitted $k_{app}$ parameter and as a representation of the extent of AT resistance for each variant compared to the wild-type FXa expressed as a ratio of their fitted $k_{app}$ values ($k_{app}$ wild-type/$k_{app}$ variant). The wild-type FXa polypeptide used for comparison was the recombinant wild-type FXa generated from cloning the FX gene set forth in SEQ ID NO:1 and expressed from CHO cells as a polypeptide with an amino acid sequence set forth as amino acids 1-139 and 195-448 of SEQ ID NO:134, as described in Examples 1-3 (i.e. FX WT polypeptide). Several FXa variants exhibited greater than 300 fold increased resistance to AT compared to wild-type FXa. For example, FXa-V196S/R332G, FXa-V196S/K420E/R424E, FXa-V196S/R332D, FXa-V196S/R332S, and FXa-V196S/K338S are among this group, which exhibited significant resistance to AT.

TABLE 22

Second-Order Rate Constant for Inhibition by AT/UFH

| Mutation (Mature FX Numbering) | Mutation (Chymotrypsin Numbering) | $k_{app}$ (M$^{-1}$s$^{-1}$) | ±S.D. (M$^{-1}$s$^{-1}$) | % CV | $k_{app\text{-}wt}/k_{app\text{-}mut}$ | n |
|---|---|---|---|---|---|---|
| Plasma FXa | Plasma FXa | 1.4E+07 | 7.2E+06 | 52% | 1 | 3 |
| FX WT | FX WT | 9.7E+06 | 4.6E+06 | 47% | 1 | 6 |
| I195L | I16L | 5.3E+05 | 9.1E+04 | 17% | 18 | 4 |
| V196S | V17S | 5.3E+05 | 1.7E+05 | 32% | 18 | 11 |
| T85N/K87S/V196S | T[85]N/K[87]S/V17S | 1.8E+05 | 2.1E+03 | 1% | 55 | 2 |
| Q56N/Q58S/V196S | Q[56]N/Q[58]S/V17S | 3.2E+05 | 2.1E+04 | 7% | 31 | 2 |
| K62N/G64S/V196S | K[62]N/G[64]S/V17S | 2.8E+05 | 4.3E+03 | 2% | 35 | 2 |
| L65N/E67S/V196S | L[65]N/E[67]S/V17S | 3.8E+05 | 1.7E+04 | 4% | 25 | 2 |

TABLE 22-continued

Second-Order Rate Constant for Inhibition by AT/UFH

| Mutation (Mature FX Numbering) | Mutation (Chymotrypsin Numbering) | $k_{app}$ ($M^{-1}s^{-1}$) | ±S.D. ($M^{-1}s^{-1}$) | % CV | $k_{app\text{-}wt}/k_{app\text{-}mut}$ | n |
|---|---|---|---|---|---|---|
| E67N/V196S | E[67]/N/V17S | 4.4E+05 | 4.3E+02 | 0% | 22 | 2 |
| L73N/G75S/V196S | L[73]N/G[75]S/V17S | 3.1E+05 | 7.6E+03 | 2% | 32 | 2 |
| G75N/E77S/V196S | G[75]N/E[77]S/V17S | 4.4E+05 | 5.2E+02 | 0% | 22 | 2 |
| R86N/L88S/V196S | R[86]N/L[88]S/V17S | 4.9E+05 | 5.2E+03 | 1% | 20 | 2 |
| G114N/V196S | G[114]N/V17S | 3.4E+05 | 8.0E+03 | 2% | 28 | 4 |
| D95N/D97S/V196S | D[95]N/D[97]S/V17S | 4.1E+05 | 2.0E+05 | 49% | 24 | 2 |
| E82S/V196S | E[82]S/V17S | 2.3E+05 | 2.2E+05 | 96% | 42 | 8 |
| E82N/F84S/V196S | E[82]N/F[84]S/V17S | 4.2E+05 | 1.6E+05 | 39% | 23 | 3 |
| G78N/N80S/V196S | G[78]N/N[80]S/V17S | 1.5E+05 | 5.0E+04 | 33% | 64 | 4 |
| E77N/K79S/V196S | E[77]N/K[79]S/V17S | 2.1E+05 | 1.2E+05 | 57% | 47 | 2 |
| D119N/G121S/V196S | D[119]N/G[121]S/V17S | 7.5E+05 | 1.7E+05 | 23% | 13 | 2 |
| L83N/V196S | L[83]N/V17S | 6.0E+05 | 3.2E+04 | 5% | 16 | 2 |
| K122S/V196S | K[122]S/V17S | 9.3E+05 | 1.4E+05 | 15% | 11 | 4 |
| E51N/V196S | E[51]N/V17S | 8.6E+05 | 2.9E+04 | 3% | 11 | 2 |
| Q58N/K60S/V196S | Q[58]N/K[60]S/V17S | 6.4E+05 | 1.3E+04 | 2% | 15 | 2 |
| G114N/D119N/G121S/V196S | G[114]N/D[119]N/G[121]S/V17S | 1.4E+05 | 8.1E+04 | 59% | 71 | 5 |
| V196T | V17T | 3.2E+06 | 8.3E+04 | 3% | 3 | 2 |
| G197S | G18S | 1.4E+06 | 3.9E+05 | 28% | 7 | 2 |
| S334T | S152T | 1.2E+07 | 3.1E+06 | 25% | 1 | 4 |
| K338A | K156A | 5.8E+06 | 1.1E+06 | 19% | | 2 |
| K338S | K156S | 3.2E+06 | 1.7E+05 | 5% | 3 | 2 |
| K338V | K156V | 3.4E+06 | 2.1E+05 | 6% | 3 | 2 |
| T327A/K338A | T144A/K156A | 1.5E+06 | 4.6E+05 | 32% | 7 | 2 |
| T327L/K338M | T144L/K156M | 5.4E+06 | 2.7E+06 | 50% | 2 | 2 |
| E200V/T327L/K338M | E21V/T144L/K156M | 3.4E+06 | 1.2E+06 | 36% | 3 | 2 |
| E200V/T327L/S334A/K338M | E21V/T144L/S152A/K156M | 3.8E+06 | 6.9E+05 | 18% | 3 | 2 |
| V196S/L211S/G219H | V17S/L32S/G40H | 2.5E+05 | 3.9E+04 | 15% | 39 | 4 |
| D119N/G121S/V196S/L211S/G219H | D[119]N/G[121]S/V17S/L32S/G40H | 9.5E+04 | n.d. | n.d. | 102 | 1 |
| G114N/V196S/L211S/G219H | G[114]N/V17S/L32S/G40H | 5.6E+04 | n.d. | n.d. | 173 | 1 |
| G114N/D119N/G121S N196S/L211S/G219H | G[114]N/D[119]N/G[121]S/V17S/L32S/G40H | 6.5E+04 | 2.2E+04 | 34% | 149 | 5 |
| G197A/L211S/G219H | G18A/L32S/G40H | 1.2E+06 | 5.2E+05 | 44% | 8 | 2 |
| I195L/L211S/G219H | I16L/L32S/G40H | 3.1E+05 | 3.1E+04 | 10% | 31 | 4 |
| V196S/N214D | V17S/N35D | 7.6E+05 | 4.0E+05 | 53% | 13 | 2 |
| V196S/N214A | V17S/N35A | 1.4E+06 | 1.0E+05 | 7% | 7 | 2 |
| V196S/N214S | V17S/N35S | 9.0E+05 | 8.4E+04 | 9% | 11 | 2 |
| V196S/E216R | V17S/E37R | 4.5E+05 | 1.4E+05 | 31% | 22 | 2 |
| V196S/N216K | V17S/E37K | 2.5E+05 | 2.7E+03 | 1% | 39 | 2 |
| V196S/N216A | V17S/E37A | 3.3E+05 | 8.4E+03 | 3% | 29 | 2 |
| V196S/N216S | V17S/E37S | 4.7E+05 | 4.1E+03 | 1% | 21 | 2 |
| V196S/E218R | V17S/E39R | 4.1E+05 | 8.8E+04 | 22% | 24 | 2 |
| V196S/N218K | V17S/E39K | 2.1E+05 | 2.3E+04 | 11% | 48 | 2 |
| V196S/N218A | V17S/E39A | 5.4E+05 | 5.5E+04 | 10% | 18 | 4 |
| V196S/R332A | V17S/R150A | 2.9E+04 | 6.7E+03 | 23% | 339 | 3 |
| V196S/R332D | V17S/R150D | 5.6E+03 | 1.9E+03 | 35% | 1,754 | 6 |
| V196S/R332E | V17S/R150E | 2.3E+04 | 4.9E+03 | 21% | 428 | 2 |
| V196S/R332S | V17S/R150S | 9.1E+03 | 7.9E+03 | 86% | 1,070 | 5 |
| V196S/R332G | V17S/R150G | 3.3E+03 | 1.4E+03 | 43% | 2,926 | 6 |
| V196S/R326D | V17S/R143D | 6.3E+03 | 4.9E+03 | 78% | 1,555 | 3 |
| V196S/R326M | V17S/R143M | 3.5E+04 | 2.9E+03 | 8% | 280 | 4 |
| V196S/R326N | V17S/R143N | 2.5E+04 | 3.0E+03 | 12% | 396 | 4 |
| V193S/R326Q | V17S/R143Q | 5.2E+04 | 1.1E+04 | 21% | 186 | 4 |
| V196S/R273E | V17S/R93E | 2.3E+04 | 4.2E+03 | 18% | 415 | 2 |
| V196S/R273A | V17S/R93A | 7.8E+03 | 1.2E+03 | 15% | 1,257 | 4 |
| V196S/R424A | V17S/R240A | 2.7E+04 | 1.4E+03 | 5% | 364 | 2 |
| V196S/R424E | V17S/R240E | 8.3E+03 | 2.7E+03 | 33% | 1,173 | 2 |
| V196S/K420A | V17S/K236A | 2.5E+04 | 3.9E+03 | 15% | 389 | 4 |
| V196S/K420E | V17S/K236E | 1.4E+04 | 8.4E+03 | 58% | 672 | 4 |
| V196S/R306E | V17S/R125A | 3.5E+04 | 5.4E+03 | 16% | 281 | 4 |
| V196S/K276A | V17S/K96A | 4.7E+05 | 1.6E+05 | 34% | 21 | 4 |
| V196S/K276E | V17S/K96E | 3.2E+05 | 1.8E+05 | 57% | 30 | 4 |
| V196S/K420E/R424E | V17S/K236E/R240E | 5.1E+03 | 2.8E+01 | 1% | 1,929 | 2 |
| V196S/K338A | V17S/K156A | 4.5E+04 | 2.5E+04 | 55% | 218 | 2 |
| V196S/K338S | V17S/K156S | 2.3E+04 | 7.6E+03 | 33% | 421 | 10 |
| V196S/E215N/N217S | V17S/E36N/N38S | 7.5E+05 | 6.4E+03 | 1% | 13 | 2 |
| V196S/E264N/E266S | V17S/E84N/E86S | 8.7E+05 | 6.1E+04 | 7% | 11 | 2 |
| D119N/G121S/V196S/E264N/E266S | D[119]N/G[121]S/V17S/E84N/E86S | 4.0E+05 | 1.8E+04 | 4% | 24 | 2 |

TABLE 22-continued

Second-Order Rate Constant for Inhibition by AT/UFH

| Mutation (Mature FX Numbering) | Mutation (Chymotrypsin Numbering) | $k_{app}$ ($M^{-1}s^{-1}$) | ±S.D. ($M^{-1}s^{-1}$) | % CV | $k_{app-wt}/k_{app-mut}$ | n |
|---|---|---|---|---|---|---|
| G114N/V196S/E264N/E266S | G[114]/IN17S/E84N/E86S | 2.0E+05 | n.d. | n.d. | 48 | 1 |
| V196S/R429N/L431S | V17S/R245N/L247S | 2.4E+05 | 5.6E+03 | 2% | 40 | 2 |
| V196S/R243N/K245S | V17S/R63N/K65S | 5.0E+05 | 1.2E+04 | 2% | 19 | 2 |
| V196S/T293N/R295S | V17S/T113N/R115S | 6.1E+05 | 1.2E+02 | 0% | 16 | 2 |
| V196S/D389N/Y391S | V17S/D205N/Y207S | 7.6E+05 | 1.7E+04 | 2% | 13 | 2 |
| V196S/K388N | V17S/K204N | 7.1E+05 | 3.0E+04 | 4% | 14 | 4 |
| D119N/G121S/V196S/K388N | D[119]N/G[121]S/V17S/K204N | 1.4E+05 | 4.9E+03 | 4% | 71 | 2 |
| V196S/T428N/G430S | V17S/T244N/G246S | 9.5E+05 | 1.6E+04 | 2% | 10 | 2 |
| V196S/L211S/G219H/E264N/E266S | V17S/L32S/G40H/E84N/E86S | 2.1E+05 | 1.5E+04 | 7% | 46 | 2 |
| D119N/G121S/V196S/L211S/G219H/E264N/E266S | D[119]N/G[121]S/V17S/L32S/G40H/E84N/E86S | 1.4E+05 | 1.7E+04 | 12% | 69 | 2 |
| G114N/V196S/L211S/G219H/E264N/E266S | G[114]N/V17S/L32S/G40H/E84N/E86S | 8.3E+04 | 1.4E+04 | 16% | 118 | 3 |
| V196S/E264N/E266S/K388N | V17S/E84N/E86S/K204N | 2.7E+05 | 1.8E+04 | 7% | 37 | 2 |
| D119N/G121S/V196S/L211S/G219H/K388N | D[119]N/G[121]S/V17S/L32S/G40H/K204N | 6.2E+04 | 7.3E+03 | 12% | 157 | 4 |
| G114N/V196S/L211S/G219H/K388N | G[114]N/V17S/L32S/G40H/K204N | 3.7E+04 | 2.1E+03 | 6% | 267 | 2 |
| V196S/L211S/G219H/E264N/E266S/K388N | V17S/L32S/G40H/E84N/E86S/K204N | 2.2E+05 | 1.2E+04 | 6% | 44 | 2 |

Example 6

Determination of the Functional Cofactor Binding ($K_{D-app}$) of FXa for its Cofactor, Factor Va The functional cofactor binding ($Kp_{D-app}$) of the FXa variants for the cofactor Factor Va (FVa) in the presence or saturating substrate, prothrombin (FII), was assessed indirectly in a fluorogenic assay by assaying for the activity of thrombin (FIIa), generated upon activation by FXa, on the synthetic substrate Pefafluor TH. A range of FVa concentrations were used to calculate the apparent kinetic rate constant ($K_{D-app}$) where the cofactor (FVa) was in excess by at least a 1000-fold over the concentration of the activating protease (FXa). The assay was designed to be a variation of the assay described in Example 4 (Determination of the Catalytic Activity of FXa for its Substrate, Prothrombin (FII)) where the cofactor (FVa) at various concentrations was preincubated with FXa in the presence of phospholipid vesicles forming the prothrombinase complex prior to assessing the catalytic activity with saturating levels of the substrate, prothrombin (FII). Briefly, activated and active site titrated FXa variants were diluted in a calcium-containing buffer with phospholipid vesicles, mixed with various concentrations of FVa to form the prothrombinase complex and were subsequently mixed with saturating concentrations of prothrombin and the fluorescent substrate, Pefafluor TH(H-D-CHA-Ala-Arg-AMC, Centerchem) to initiate the assay. The release of the free fluorophore, AMC (7-amino-4-methylcoumarin) following catalysis of Pefafluor TH by the generated thrombin was then measured continuously over a time period, and the kinetic rate constants of the FXa variants were determined.

A. Assay Protocol

For assays evaluating the kinetic rate of prothrombin activation by FXa in the presence of various FVa concentrations (plasma purified FVa, Heamatologic Technologies, Inc.) and phospholipids, the FXa variants were expressed, purified, activated and active site titrated as described in Examples 1-3, above. FXa variants were then serially diluted to concentrations of 0.4-8 µM (4×) in a 0.25 mL volume of 1× Buffer A (20 mM Hepes/150 mM NaCl/5 mM $CaCl_2$/0.1% BSA/0.1% PEG-8000, pH 7.4). FVa was further diluted to various top concentrations depending on the tested variants, but typically ranged from of 2-60 nM (4× of the top dose) in a 1.0 mL volume of 1× Buffer A containing 80 µM freshly resuspended phospholipids (75% phosphatidylcholine (PC)/25% phospatidylserine (PS); PS/PC vesicles ~120 nm in diameter; Avanti Polar Lipids). FVa solutions were serially diluted 1.8-fold in a 12-channel deep-well polypropylene plate with a final volume of 0.4 mL of 1× Buffer A containing 80 µM PC/PS vesicles (4×). The dilution series of FVa was subsequently mixed 1:1 with the 4×FXa dilutions (25 µL each) in a 96-well round-bottom black assay plate according to a predefined plate map (4 FXa variants/plate) and preincubated 15 min at 25° C. to form equilibrated prothrombinase complexes with varied concentrations of FVa. Final 2× solutions (50 µL) were as follows: 0.2-4 µM FXa variant, 60-0 nM FVa and 40 µM PC/PS vesicles.

A solution of 5000 nM (2×) active site titrated and DFP/FPR-cmk treated prothrombin (FII) was prepared in 30 mL of 1× Buffer A containing 0.1 mM Pefafluor TH substrate providing a sufficient volume for 4 assays. This represented a 2× saturating concentration of prothrombin (FII) that would be at least 10-50-fold above the $K_M$ values reported in Example 4, Table 17. Assay reactions were typically initiated using a BioMek FX liquid handling system programmed to dispense 50 µL of the FII/Pefafluor TH dilutions into 4 assay plates containing 50 µL of each FXa variant and FVa dilution (prothrombinase complexes). The final concentrations of the reagents in the assay were as follows: 0.1-2.0 µM FXa, 20 µM PC/PS vesicles, 50 µM Pefafluor TH, 2.5 µM prothrombin (FII) and 0-0.5 nM, 0-1.0 nM, 0-3.0 nM or 0-10 nM FVa dilutions, although other FVa dilution ranges were sometimes employed. Reactions were monitored in a SpectraMax fluorescence plate reader for 30 min at 25° C. A standard curve of free AMC served as the conversion factor for RFU to 1.1M in the subsequent data analysis calculations using a dose range that covered 0 µM to 100 µM AMC.

B. Data Analysis

To determine functional affinity of FXa variants for FVa based on their catalytic activity, raw data collected with the SoftMax Pro application (Molecular Devices) were exported as .TXT files. Further non-linear data analyses were performed directly within the ActivityBase software package using the XE Runner data analysis module (IDBS Software). Data analyses were essentially as described in Example 4C with minor modifications. The Abase template was set up to automatically fit the parabolic reaction velocities (µM/sec$^2$) of the tested FXa variants at each FVa concentration to the function of a standard rectangular hyperbola (i.e. Michaelis Menten equation) given by equation (10) to yield the fit values for $V_{max}$ and $K_{D-app}$.

$$\text{Reaction Velocity } (\mu M / \sec^2) = \frac{V_{max}[S_0]}{K_{D-app} + [S_0]} \quad \text{Equation (10)}$$

Table 23 sets forth the functional affinity ($K_{D-app}$) for each of the FXa variants assayed. Also assayed were recombinant wild-type FXa (termed FXa WT), and plasma purified FXa (Haematologic Technologies, Inc). Table 23 presents the results expressed as the kinetic constant for affinity, $K_{D-app}$ (nM), and also as a ratio of the functional affinity of the wild-type FXa compared to that of the FXa variant, wherein the functional affinity of each FXa variant is defined by the $K_{D-app}$ (nM) value for activation of the substrate, prothrombin (FII). Where the activity of the FXa variant was compared to wild-type FXa, it was compared to a recombinant wild-type FXa polypeptide that was expressed and purified using the same conditions as used for the variant FXa polypeptides to ensure that any differences in activity were the result of the mutation(s), and not the result of differences in; for example, post-translational modifications associated with different expression systems. Thus, the wild-type FXa polypeptide used for comparison was the recombinant wild-type FXa generated from cloning the FX gene, whose sequence is set forth in SEQ ID NO:1, and expressed from CHO cells as a polypeptide with an amino acid sequence set forth as amino acids 1-139 and 195-448 of SEQ ID NO:134, as described in Examples 1-3 (i.e. FXa WT polypeptide). The standard deviation (S.D.), coefficient of variation (as a percentage; % CV) and the number of assays performed (n) also are provided in Table 23.

While some variants showed similar to wild-type affinities or nominal increases in $K_{D-app}$ (e.g. FXa-R326Y and FIXa-FXa-L211S/G219H) several variants showed marked decreases in functional affinity with greater than 10-100 fold increases in $K_{D-app}$. Variants with significantly increased cofactor dependence (Example 4) showed the greatest decreases in functional cofactor affinity. For instance, FXa-V196S/R326Q, FXa-V196S/K420E/R424E, FXa-V196S/R273E, and FXa-V196S/K338S are among this group.

TABLE 23

Functional Cofactor Affinity of FXa variants ($K_{D-app}$)

| Mutation (Mature FX Numbering) | Mutation (Chymotrypsin Numbering) | $K_{D-app}$ (nM) | ±S.D. (nM) | % CV | $K_{D-WT}/K_{D-mut}$ | n |
|---|---|---|---|---|---|---|
| Plasma FXa | Plasma FXa | 0.01 | 0.00 | 21% | 1.64 | 5 |
| FX WT | FX WT | 0.02 | 0.01 | 47% | 1.00 | 3 |
| I195L | I16L | 0.18 | 0.06 | 33% | 0.09 | 10 |
| V196S | V17S | 0.39 | 0.12 | 32% | 0.04 | 14 |
| Q56N/Q58S/V196S | Q[56]N/Q[58]S/V17S | 0.49 | 0.18 | 37% | 0.03 | 2 |
| K62N/G64S/V196S | K[62]N/G[64]S/V17S | 0.72 | 0.25 | 34% | 0.02 | 2 |
| E67N/V196S | E[67]N/V17S | 1.08 | 0.13 | 12% | 0.01 | 2 |
| L73N/G75S/V196S | L[73]N/G[75]S/V17S | 0.45 | 0.07 | 16% | 0.04 | 2 |
| G75N/E77S/V196S | G[75]N/E[77]S/V17S | 0.90 | 0.28 | 31% | 0.02 | 2 |
| G114N/V196S | G[114]N/V17S | 0.73 | 0.24 | 32% | 0.02 | 3 |
| D119N/G121S/V196S | D[119]N/G[121]S/V17S | 0.62 | 0.19 | 30% | 0.03 | 3 |
| K122S/V196S | K[122]S/V17S | 0.46 | 0.17 | 37% | 0.03 | 3 |
| E51N/V196S | E[51]N/V17S | 0.38 | 0.05 | 14% | 0.04 | 2 |
| Q58N/K60S/V196S | Q[58]N/K[60]S/V17S | 0.52 | 0.19 | 36% | 0.03 | 3 |
| L211S/G219H | L32S/G40H | 0.02 | 0.00 | 7% | 0.67 | 3 |
| V196L | V17L | 0.06 | 0.01 | 21% | 0.27 | 3 |
| V196T | V17T | 0.31 | n.d. | n.d. | 0.05 | 1 |
| G197S | G18S | 0.18 | 0.07 | 39% | 0.09 | 3 |
| R326A | R143A | 0.03 | n.d. | n.d. | 0.60 | 1 |
| R326S | R143S | 0.03 | n.d. | n.d. | 0.55 | 1 |
| R326T | R143T | 0.04 | n.d. | n.d. | 0.42 | 1 |
| R326Q | R143Q | 0.03 | n.d. | n.d. | 0.50 | 1 |
| R326N | R143N | 0.04 | 0.01 | 22% | 0.44 | 2 |
| R326M | R143M | 0.04 | n.d. | n.d. | 0.39 | 1 |
| R326K | R143K | 0.03 | n.d. | n.d. | 0.60 | 1 |
| R326Y | R143Y | 0.02 | 0.00 | 2% | 0.86 | 2 |
| K338A | K156A | 0.20 | n.d. | n.d. | 0.08 | 1 |
| K338S | K156S | 0.15 | 0.04 | 25% | 0.11 | 3 |
| K338N | K156N | 0.06 | n.d. | n.d. | 0.25 | 1 |
| K338R | K156R | 0.02 | 0.01 | 55% | 0.73 | 2 |
| K338V | K156V | 0.15 | 0.05 | 35% | 0.11 | 3 |
| K338M | K156M | 0.36 | n.d. | n.d. | 0.04 | 1 |
| T327A/K338A | T144A/K156A | 0.24 | 0.15 | 59% | 0.06 | 2 |
| T327L/K338M | T144L/K156M | 0.03 | 0.00 | 17% | 0.61 | 2 |
| E200V/T327L/S334A/K338M | E21V/T144L/S152A/K156M | 0.11 | 0.04 | 37% | 0.14 | 3 |

TABLE 23-continued

Functional Cofactor Affinity of FXa variants ($K_{D-app}$)

| Mutation (Mature FX Numbering) | Mutation (Chymotrypsin Numbering) | $K_{D-app}$ (nM) | ±S.D. (nM) | % CV | $K_{D-WT}/K_{D-mut}$ | n |
|---|---|---|---|---|---|---|
| V196S/L211S/G219H | V17S/L32S/G40H | 0.32 | 0.09 | 29% | 0.05 | 2 |
| I195L/L211S/G219H | I16L/L32S/G40H | 0.37 | 0.05 | 14% | 0.04 | 3 |
| V196S/N214D | V17S/N35D | 0.32 | 0.07 | 23% | 0.05 | 3 |
| V196S/N214A | V17S/N35A | 0.38 | n.d. | n.d. | 0.04 | |
| V196S/N214S | V17S/N35S | 0.33 | n.d. | n.d. | 0.05 | 1 |
| V196S/E216R | V17S/E37R | 0.16 | 0.06 | 38% | 0.10 | 3 |
| V196S/N216K | V17S/E37K | 0.25 | 0.06 | 23% | 0.06 | 2 |
| V196S/N216A | V17S/E37A | 0.29 | 0.12 | 41% | 0.05 | 2 |
| V196S/N216S | V17S/E37S | 0.40 | 0.13 | 31% | 0.04 | 3 |
| V196S/E218R | V17S/E39R | 0.34 | 0.12 | 34% | 0.05 | 3 |
| V196S/N218K | V17S/E39K | 0.29 | 0.05 | 18% | 0.05 | 2 |
| V196S/N218A | V17S/E39A | 0.36 | 0.13 | 35% | 0.04 | 3 |
| V196S/R332A | V17S/R150A | 0.54 | n.d. | n.d. | 0.03 | 1 |
| V196S/R332D | V17S/R150D | 1.70 | 0.60 | 35% | 0.01 | 3 |
| V196S/R332E | V17S/R150E | 0.49 | 0.04 | 7% | 0.03 | 2 |
| V196S/R332S | V17S/R150S | 0.56 | 0.11 | 19% | 0.03 | 2 |
| V196S/R332G | V17S/R150G | 0.56 | 0.12 | 22% | 0.03 | 3 |
| V196S/R326D | V17S/R143D | 1.02 | 0.33 | 32% | 0.02 | 3 |
| V196S/R326M | V17S/R143M | 0.56 | 0.27 | 48% | 0.03 | 4 |
| V196S/R326N | V17S/R143N | 2.21 | 0.15 | 7% | 0.01 | 2 |
| V196S/R326Q | V17S/R143Q | 1.21 | 0.26 | 21% | 0.01 | 3 |
| V196S/R273E | V17S/R93E | 15.04 | 3.42 | 23% | 0.001 | 3 |
| V196S/R273A | V17S/R93A | 2.45 | 0.08 | 3% | 0.01 | 3 |
| V196S/R424A | V17S/R240A | 5.86 | 0.11 | 2% | 0.003 | 2 |
| V196S/R424E | V17S/R240E | 6.31 | 1.00 | 16% | 0.002 | 3 |
| V196S/K420A | V17S/K236A | 0.37 | n.d. | n.d. | 0.04 | 1 |
| V196S/K420E | V17S/K236E | 0.39 | n.d. | n.d. | 0.04 | 1 |
| V196S/R306E | V17S/R125A | 2.25 | 1.49 | 66% | 0.01 | 5 |
| V196S/K276A | V17S/K96A | 0.62 | 0.11 | 18% | 0.03 | 3 |
| V196S/K276E | V17S/K96E | 0.70 | 0.02 | 3% | 0.02 | 3 |
| V196S/K420E/R424E | V17S/K236E/R240E | 20.86 | 13.15 | 63% | 0.001 | 4 |
| V196S/K338A | V17S/K156A | 0.93 | 0.24 | 26% | 0.02 | 3 |
| V196S/K338S | V17S/K156S | 0.91 | 0.19 | 21% | 0.02 | 3 |
| V196S/E215N/N217S | V17S/E36N/N38S | 0.28 | 0.03 | 10% | 0.06 | 2 |
| V196S/E264N/E266S | V17S/E84N/E86S | 0.48 | 0.03 | 6% | 0.03 | 2 |
| V196S/R429N/L431S | V17S/R245N/L247S | 1.06 | 0.34 | 32% | 0.01 | 2 |
| V196S/T293N/R295S | V17S/T113N/R115S | 0.64 | 0.15 | 23% | 0.02 | 2 |
| V196S/K388N | V17S/K204N | 0.59 | 0.06 | 10% | 0.03 | 2 |
| V196S/T428N/G430S | V17S/T244N/G246S | 0.73 | 0.10 | 14% | 0.02 | 2 |

Example 7

Pharmacokinetic Analysis of FXa Polypeptides

The pharmacokinetic (PK) properties of the FXa variant polypeptides were assessed by measuring the amount of variant FXa in mouse plasma at various time-points following intravenous administration. An ELISA assay was used to quantify total FXa protein in mouse plasma to assess the pharmacokinetic properties.

A. Animals.

Male CD-1 mice (30-40 gm), supplied by Charles Rivers Laboratories (Hollister, Calif.) were quarantined for at least 3 days before treatment. For serial PK studies, male CD-1 mice (30-37 gm) were fitted with an indwelling jugular vein cannula. Filtered tap water and food were available ad libitum prior to use in PD or PK experiments.

B. Dosing and Blood Collection

Mice (N=3 per time point) were administered the FXa polypeptides intravenously (0.5 mg/kg, dose volume 2 ml/kg) via the tail vein. At the appropriate time (2-960 min) after dosing, animals were anesthetized and blood was drawn (0.5-1 mL) using terminal cardiac puncture into syringes containing citrate. Where insufficient amount of protein was available for terminal PK studies, serial bleeding using a total of only 4-6 animals and staggered time points was utilized; two mice were used for each full time course in order to collect all time points without removing excess blood volume. For serial bleeding experiments, blood was sampled in restrained conscious animals by first removing a small amount of blood into a 0.1 mL syringe containing 0.9% saline. A syringe containing 4.5 µM of 0.1M sodium citrate was then attached and 0.05 mL blood was withdrawn into the syringe and the blood was transferred to a 1.5 mL tube. The initial syringe was reattached and 0.07 mL of saline pushed back through the cannula. The cannula was capped until the next time point, when the process was repeated. For both serial and terminal studies, blood samples were centrifuged within 15 minutes of collection (9000 rpm, 8 minutes, 4° C.) and the plasma removed and immediately flash frozen in liquid nitrogen and then stored frozen (−70° C.) pending analysis.

C. PK Assessment.

Citrated blood samples were collected at various times up to 960 min post dose (i.e., Pre-dose, 2, 5, 10, 15, 30, 60, 120, 240, 360, and 960 min) by cardiac puncture for terminal experiments or indwelling catheter for serial experiments as described in Example 7B above. Plasma concentrations of FXa were determined using a human Factor X/Xa specific ELISA. A matched pair of polyclonal detection and capture antibodies (#FX-EIA-C, Affinity Biologicals, Ancaster, ON) was used. The FX/Xa ELISA provided a measure used to determine the pharmacokinetic parameters of the variant of interest.

Briefly, an affinity purified polyclonal antibody to FX/Xa (1:500) was coated onto the wells of a plate in Coating Buffer (15 mM $Na_2CO_3$, 35 mM $NaHCO_3$, pH 9.6) for 2 hours at room temperature (RT). The plates were washed with Wash Buffer (PBST) and plasma samples containing FX/Xa diluted in Sample Diluent (100 mM Hepes, 100 nM NaCl, 10 mM EDTA, 1.0% BSA, 0.1% Tween-20, pH 7.2) were applied. All samples and standards were normalized to a final concentration of 1:200 CD-1 mouse plasma diluted into Sample Diluent to maintain consistency. Plasma samples were diluted 1:200 and 1:1000 on the plate followed by a subsequent 1:4 dilution giving an additional dilution set of 1:1000 and 1:4000. After washing the plate to remove unbound material, a peroxidase conjugated detection antibody (1:1000) to FX/Xa was added to the plate to bind to the captured FX/Xa. After washing the plate to remove unbound conjugated antibody, the peroxidase activity was initiated by incubation with chemiluminescent substrate (SuperSignal Femto, #37074, Thermo Scientific). The chemiluminescent signal was measured using a SpectraMax fluorescence plate reader. The standard curve of peroxidase activity is characteristically linear over a concentration range of 0.82 pg/ml to 25 ng/ml. The FXa variant itself was used for the standard curve to eliminate differences in the antibody affinity to different FXa variants. Each sample was measured on two separate assay plates and those measurements within the linear range of the standard curve were used to calculate the concentration of FXa variants in the plasma sample.

D. PK Data Analysis.

PK (ELISA) parameters from mouse studies with FXa variants were calculated using non compartmental analysis in WinNonLin (v5.1, Pharsight Corp., Mountain View, Calif.). The PK of FXa variants followed apparent biexponential plasma decay. Select parameters for each variant tested are provided in Table 25. The PK parameters included half-life (terminal, min), MRT ($MRT_{0-last}$, min), Area under the curve (AUC), 0-last (min.μg/mL)/Dose (mg/kg); Maximal concentration ($C_{max}$; (μg/mL)/Dose (μg/kg), Vd (mL/kg) and Clearance (Cl, mL/min/kg).

TABLE 24

Definitions and Formulae Used to Calculate Pharmacokinetic Parameters.

| Term/Formula | Definition |
| --- | --- |
| Plasma half-life Beta $T_{1/2}$ ($T_{1/2\,\beta}$) | the half life of the FXa polypeptide during the terminal phase of plasma FXa concentration-versus-time profile calculated as $-\ln 2$ divided by the negative slope during the terminal phase of the log-linear plot of the plasma FXa concentration-versus-time curve |
| $MRT_{0-last}$ | the mean time the FXa polypeptide resides in body; calculated as $AUMC_{0-last}/AUC_{0-last}$, where $AUMC_{0-last}$ is the total area under the first moment-versus-time curve and AUC as described subsequently |
| $AUC_{0-last}$/Dose | calculated as $[AUC_{(0-t)}]$, where t is the last time point with measurable plasma concentration of the FXa polypeptide divided by the IV dose (mg/kg) |
| $AUC_{0-inf}$/Dose | calculated as $[AUC_{(0-t)}] + Ct/(\ln 2/T_{1/2\,\beta})]$, where t is the last time point with measurable plasma concentration of the FXa polypeptide divided by the IV dose (mg/kg) |
| $C_{max}$/Dose | (ug/mL per mg/kg) |
| $C_{max}$ | the time post dose corresponding to the maximal measured plasma FXa concentration |
| Cl | systemic clearance calculated as (Dose/$AUC_{0-inf}$) |
| $V_{ss}$ | steady state volume of distribution; calculated as MRT*Cl |
| $V_z$ | volume of distribution based on the terminal elimination constant(β); calculated as Cl/($\ln 2/T_{1/2\,\beta}$) |

TABLE 25

PK properties of FXa variants assessed by ELISA

| Mutant (Mature Numbering) | Mutant (Chymo Numbering) | n | Beta $T_{1/2}$ | $T_{max}$ | $C_{max}$/ Dose | $AUC_{0-last}$/ Dose | $AUC_{0-inf}$/ Dose | Vz | Cl | MRT (0-last) | MRT (0-inf) |
| --- | --- | --- | --- | --- | --- | --- | --- | --- | --- | --- | --- |
| I195L | I16L | 4 | 320 | 4 | 16 | 548 | 788 | 577 | 1.3 | 81 | 312 |
| E82S/V196S | E[82]S/V17S | 1 | 403 | 22 | 29 | 1719 | 3388 | 172 | 0.3 | 272 | 120 |
| V196S | V17S | 4 | 523 | 3 | 30 | 1840 | 2757 | 306 | 0.44 | 241 | 743 |
| G197S | G18S | 2 | 225 | 6 | 17 | 1584 | 2383 | 134 | 0.43 | 125 | 310 |
| K338A | K156A | 2 | 462 | 2 | 21 | 1411 | 1844 | 350 | 0.56 | 267 | 577 |
| K338S | K156S | 2 | 570 | 4 | 16 | 795 | 1770 | 402 | 0.71 | 106 | 715 |
| V196S/L211S/ G219H | V17S/L32S/ G40H | 2 | 405 | 4 | 23 | 1408 | 1723 | 336 | 0.58 | 248 | 483 |
| I195L/L211S/ G219H | I16L/L32S/ G40H | 2 | 337 | 4 | 23 | 1095 | 1708 | 284 | 0.59 | 111 | 377 |
| V196S/R332A | V17S/R150A | 1 | 172 | 5 | 19 | 1205 | 1522 | 163 | 0.66 | 110 | 213 |
| V196S/R332D | V17S/R150D | 2 | 427 | 2 | 14 | 1250 | 1503 | 410 | 0.67 | 249 | 473 |
| V196S/R332S | V17S/R150S | 2 | 516 | 2 | 20 | 632 | 1471 | 382 | 1.07 | 67 | 626 |
| V196S/R332G | V17S/R150G | 1 | 266 | 2 | 22 | 1029 | 1463 | 262 | 0.68 | 101 | 292 |
| E67N/V196S | E[67]N/V17S | 2 | 322 | 2 | 20 | 1113 | 1396 | 328 | 0.72 | 157 | 337 |
| R86N/L88S/ V196S | R[86]N/L[88]S/ V17S | 2 | 249 | 2 | 21 | 747 | 1353 | 267 | 0.74 | 75 | 309 |
| D95N/D97S/ V196S | D[95]N/D[97]S/ V17S | 2 | 162 | 10 | 16 | 938 | 1333 | 178 | 0.76 | 75 | 195 |
| D119N/G121S/ V196S | D[119]N/ G[121]S/V17S | 2 | 473 | 2 | 21 | 755 | 1312 | 566 | 0.82 | 87 | 489 |
| L83N/V196S | L[83]N/V17S | 2 | 213 | 4 | 23 | 981 | 1298 | 251 | 0.84 | 91 | 226 |
| V196S/E264N/ E266S | V17S/E84N/ E86S | 2 | 400 | 2 | 23 | 987 | 1296 | 441 | 0.77 | 149 | 383 |
| V196S/R243N/ K245S | V17S/R63N/ K65S | 2 | 306 | 4 | 15 | 1150 | 1269 | 348 | 0.79 | 217 | 329 |
| V196S/D389N/ Y391S | V17S/D205N/ Y207S | 2 | 267 | 2 | 23 | 1046 | 1250 | 308 | 0.87 | 166 | 306 |
| V196S/K388N | V17S/K204N | 1 | 514 | 2 | 18 | 639 | 1151 | 644 | 0.87 | 104 | 548 |
| G114N/V196S | G[114]N/V17S | 2 | 277 | 2 | 22 | 808 | 1132 | 342 | 0.91 | 93 | 285 |
| T85N/K87S/ V196S | T[85]N/K[87]S/ V17S | 2 | 309 | 2 | 19 | 933 | 1131 | 370 | 0.99 | 175 | 341 |

TABLE 25-continued

PK properties of FXa variants assessed by ELISA

| Mutant (Mature Numbering) | Mutant (Chymo Numbering) | n | Beta $T_{1/2}$ | $T_{max}$ | $C_{max}$/Dose | $AUC_{0-last}$/Dose | $AUC_{0-inf}$/Dose | Vz | Cl | MRT (0-last) | MRT (0-inf) |
|---|---|---|---|---|---|---|---|---|---|---|---|
| G114N/V196S/L211S/G219H | G[114]N/V17S/L32S/G40H | 2 | 326 | 2 | 22 | 928 | 1098 | 412 | 0.92 | 137 | 289 |
| G78N/N80S/V196S | G[78]N/N[80]S/V17S | 1 | 195 | 2 | 14 | 631 | 768 | 373 | 1.31 | 93 | 194 |
| D119N/G121S/V196S/E264N/E266S | D[119]N/G[121]S/V17S/E84N/E86S | 1 | 384 | 2 | 12 | 611 | 741 | 689 | 1.39 | 139 | 351 |
| V196S/L211S/G219H/E264N/E266S | V17S/L32S/G40H/E84N/E86S | 1 | 249 | 2 | 12 | 522 | 658 | 540 | 1.55 | 78 | 210 |
| D19N/G121S/V196S/L211S/G219H | D[119]N/G[121]S/V17S/L32S/G40H | 1 | 332 | 6 | 11 | 530 | 614 | 786 | 1.63 | 112 | 239 |

Example 8

In Vivo Assessment of FXa Polypeptide Procoagulant Activity

A line of mice deficient in FVIII (FVIII$^{-/-}$) was established as a mouse model of hemophilia A to assess the procoagulant activity of FXa polypeptides. The mice were treated with FXa polypeptide and the amount of blood lost in 20 minutes was measured to determine the procoagulant activity of the FXa polypeptides.

A. In Vivo Assessment of FXa Polypeptide Procoagulant Activity

Male FVII$^{-/-}$ mice were anesthetized by intraperitoneal administration of a ketamine/xylazine cocktail (45 mg/ml and 3.6 mg/ml in saline) and placed on a heated platform (39° C.) to ensure there was no drop in body temperature. The procedure room was kept at a temperature of 82° F. Ten (10) minutes prior to tail cut the tail was immersed in 10 mL of pre-warmed PBS (15 mL centrifuge tube; 39° C.). Up to fifteen mice were injected with recombinant human FXa (diluted in 5 mM MES pH 5.5, 100 mM NaCl) or modified FXa polypeptides (diluted in 5 mM MES pH 6, 100 mM NaCl) via the tail vein in a single injection. A negative control group of mice received the appropriate buffer only. In instances where the injection was missed, the animal was excluded from the study.

Injection with FXa polypeptide or buffer was made 5 minutes prior to tail cut. The tail cut was made using a razor blade 5 mm from the end of the tail, and blood was collected into PBS for a period of 20 minutes. At the end of the collection period, total blood loss was assessed. The collection tubes were mixed and a 1 ml aliquot of each sample was taken and assayed for hemoglobin content. Triton X-100 was diluted 1:4 in sterile water and 100 µL was added to the 1 mL samples to cause hemolysis. The absorbance of the samples was then measured at a wavelength of 546 nm. To calculate the amount of blood lost, the absorbance was read against a standard curve generated by measuring the absorbance at 546 nm of known volumes of murine blood, diluted in PBS and hemolyzed as above with Triton X-100. Values are expressed as Mean±SEM.

1. Dose Response Study Assessing Wild-Type FXa Coagulant Activity

In one study, the coagulant activity of wild-type FXa was analyzed in FVIII$^{-/-}$ mice as described above using doses of 0.1, 0.3 and 1 mg FXa/kg body weight. The blood loss in the control group, receiving buffer (5 mM MES pH 5.5, 100 mM NaCl) only was 940.95±30.78 µl (n=9). Treatment with wild-type FXa at 0.1 mg/kg had no inhibitory effect on blood loss (958.76±31.91 n=9), while treatment with 0.3 mg/kg and 1 mg/kg resulted in inhibition of blood loss to 870.36±53.92 µl and 802.62±52.92 µl, respectively (n=10 at each dose). An accurate ED50 value could not be determined for this study due to the toxicity observed for high doses of wild-type FXa.

In a subsequent study, the maximum tolerated dose (MTD) of wild type FXa was determined to be 0.125 mg/kg. A further study tested coagulation following a single dose of 0.1 mg/kg. In this experiment treatment with wild type FXa had no inhibitory effect on blood loss compared to the buffer-only group (890.14±23.97 µl to 914.03±23.48 µl (buffer group, n=15; dose group, n=10). Statistical analysis using Kruskall-Wallis followed by a Dunn's post test (dose response experiment), and a Mann Whitney test (single dose experiment) respectively, demonstrated no significant inhibition of blood loss with wild type FXa at 0.1 mg/kg.

2. Dose Response Studies Assessing FXa-I195L (I16L) Coagulant activity

The dose response of the procoagulant effect of the I195L (I16L according to chymotrypsin numbering) FXa mutant was tested in mice as described above. In the first analysis, the blood loss in the group of animals receiving only buffer (5 mM MES pH 6, 100 mM NaCl) was 930.74±16.33 µl (n=9). Treatment with FXa-I195L (I16L) at 0.2, 0.6 and 2 mg/kg resulted in significant inhibition of blood loss: 717.34±41.34 µl (n=8), 704.93±46.45 (n=10), and 488±95.65 µl (n=11), respectively (p<0.05 using Kruskal-Wallis followed by Dunn's post test):

In a second test, the blood loss in the buffer-only group was 910.85±23.79 µl (n=12). Treatment with FXa-I195L (I16L) at 0.46 mg/kg resulted in a non significant inhibition of blood loss (828.24±36.79 µl; n=8). However treatment with FXa-I195L (I16L) at increased doses of 1.53 and 4.58 mg/kg resulted in significant inhibition of blood loss: 690.99±41.88

μl (n=9) and 121.62±76.52 μl (n=7), respectively, compared to the control group (p<0.05 using Kruskal-Wallis followed by Dunn's post test).

3. Dose Response Studies Assessing FXa-V196S (V17S) Coagulant Activity

The dose response of the procoagulant effect of FXa-V196S (V17S according to chymotrypsin numbering) mutants was assessed in FVIII$^{-/-}$ mice, using the above methods. In the first test, the blood loss in the control group of animals, receiving buffer (5 mM MES pH 6, 100 mM NaCl) only was 855.94±62.55 μl (n=9). Treatment with FXa-V196S (V17S) at 0.7 and 2.33 mg/kg resulted in a non-significant inhibition of blood loss compared to the control group: 737.16±21.75 μl (n=8) and 614.38±75.13 μl (n=8), respectively. An increased FXa-V196S (V17S) dose of at 6.98 mg/kg, however, did result in a significant inhibition of blood loss compared to the buffer-only group (151.51±32.43 μl (n=7); p<0.05 using Kruskal-Wallis followed by Dunn's post test).

In a second test, the blood loss in the buffer-only group was 877.36±41.7 μl (n=8). Treatment with FXa-V196S (V17S) at 0.7 mg/kg resulted in a non-significant inhibition of blood loss (532.80±53.34 μl; n=9); whereas treatment with FXa-V196S (V17S) at 2.33 and 6.98 mg/kg led to an inhibition of blood loss which was significant compared to the buffer-only group (189.66±40.14 μl (n=8) and 89.28±14.46 μl (n=7), respectively; p<0.05 using Kruskal-Wallis followed by Dunn's post test).

In a third test, the blood loss in the buffer-only group was 1018.82±27.13 (n=9). Treatment with FXa-V196S (V17S) at 0.7 mg/kg resulted in a non significant inhibition of blood loss (760.27±25.92 n=9). Treatment with FXa-V196S (V17S) at 2.33 and 6.98 mg/kg led to an inhibition of blood loss which was significant compared to the buffer-only group (414.06±61.890 (n=9) and 187.24±25.08 μl (n=9), respectively; p<0.05 using Kruskal-Wallis followed by Dunn's post test).

4. Dose Response Studies Assessing FXa Mutant Coagulant Activity at Reduced Temperature FXa-V196S (V17S) coagulation activity was also assessed at a room temperature of 72-74° F., whereas previous experiments (Example 8A1-3) were conducted at a room temperature of 82° F. In the first assessment, the blood loss in the buffer-only group was 939.93±19.12 μl (n=9). Treatment with FXa-V196S (V17S) at 0.7 mg/kg produced a non-significant reduction in blood loss (798.71±26.04 μl; n=9), whereas treatment with FXa-V196S (V17S) at 2.33 and 6.98 mg/kg led to significant reductions in blood loss compared to the buffer-only group (502.48±93.31 μl (n=8) and 141.81±30.37 μl (n=9), respectively; p<0.05 using Kruskal-Wallis followed by Dunn's post test).

In a second assessment at a room temperature of 72-74° F., the blood loss in the buffer-only group was 977.42±20.61 μl (n=9). Treatment with FXa-V196S (V17S) at 0.7 mg/kg resulted in a non-significant reduction in blood loss (690.52±79.41 μl; n=10). Treatment with FXa-V17S at both 2.33 and 6.98 mg/kg led to a significant inhibition of blood loss compared to the buffer-only group (305.74±70 μl (n=10) and 152.42±37.44 μl (n=10), respectively; p<0.05 using Kruskal-Wallis followed by Dunn's post test).

The coagulation activities of other FXa-polypeptides were determined as described above at a room temperature of 72-74° F. The calculated $ED_{50}$ values using non-linear regression, for the FXa-polypeptides tested are shown in Table 26 below.

TABLE 26

Dose Response $ED_{50}$ values

| Mutant (Mature Numbering) | Mutation (Chymotrypsin Numbering) | n/group/expt | N (expts) | Average ED50 (mg/kg) |
|---|---|---|---|---|
| I195L | I16L | 7-12 | 2 | 2.5 |
| V196S | V17S | 7-10 | 5 | 2.0 |
| G114N/V196S | G[114]N/V17S | 8-10 | 2 | 1.4 |
| D95N/D97S/V196S | D[95]N/D[97]S/V17S | 8-10 | 2 | >3 |
| E82S/V196S | E[82]S/V17S | 8-10 | 2 | >3 |
| G197S | G18S | 8-10 * | 2 | 0.7 |
| K338A | K156A | 7-10 | 3 | 1.9 |
| K338S | K156S | 7-10 | 2 | 1.6 |
| V196S/L211S/G219H | V17S/L32S/G40H | 7-10 | 3 | 2.5 |
| I195L/L211S/G219H | I16L/L32S/G40H | 8-9 | 3 | 1.7 |
| V196S/R332A | V17S/R150A | 8-10 | 2 | 0.2 |
| Y196S/R332D | V17S/R150D | 8-10 | 3 | 0.08 |
| V196S/R332S | V17S/R150S | 8-9 | 3 | 0.1 |
| V196S/R332G | V17S/R150G | 8-10 | 5 | 0.2 |
| V196S/K338A | V17S/K156A | 8 | 1 | 7.9 |
| V196S/K338S | V17S/K156S | 8-10 | 1 | >5 |
| V196S/E264N/E266S | V17S/E84N/E86S | 8-10 | 2 | 2.7 |
| V196S/R243N/K245S | V17S/R63N/K65S | 8-10 | 2 | >3 |
| V196S/L211S/G219H/E264N/E266S | V17S/L32S/G40H/E84N/E86S | 9-10 | 2 | 2.1 |
| D119N/G121S/V196S/L211S/G219H/K388N | D[119]N/G[121]S/V17S/L32S/G40H/K204N | 8-10 | 2 | >3 |

* = The highest dose group in experiment 2 has 3 animals only, deaths were observed at this dose.

Since modifications will be apparent to those of skill in this art, it is intended that this invention be limited only by the scope of the appended claims.

SEQUENCE LISTING (557 sequences)

SEQ ID NO: 1 - DNA, 1467 bp, Homo sapiens
  Factor X coding sequence
  ref <308>: DATABASE ACCESSION NUMBER: NCBI: NM_000504.3
  ref <309>: DATABASE ENTRY DATE: 2012-01-23
atggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattattcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaaccattctgagcgagttctacatcctaacggcagcccactgtctctaccaagccaagagattcaaggtgagggtaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtga

SEQ ID NO: 2 - protein, 488 aa, Homo sapiens
  Factor X protein
  PROPEP (1)...(31): signal peptide
  PROPEP (32)...(40): propeptide
  CHAIN (41)...(488): mature Factor X
  CHAIN (41)...(179): Factor X light chain
  CHAIN (183)...(488): Factor X heavy chain
  PROPEP (183)...(234): activation peptide
  CHAIN (235)...(488): activated Factor Xa heavy chain
  ref <308>: DATABASE ACCESSION NUMBER: UniProtKB: P00742
  ref <309>: DATABASE ENTRY DATE: 1989-10-01
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 3 - protein, 448 aa, Artificial Sequence
  Factor X I195L
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 4 - protein, 488 aa, Artificial Sequence
  Factor X V196I (V236I) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIIGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 5 - protein, 488 aa, Artificial Sequence
  Factor X V196S (V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 6 - protein, 488 aa, Artificial Sequence
  Factor X T85N/K87S/V196S  (T125N/K127S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFNRSLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 7 - protein, 488 aa, Artificial Sequence
  Factor X Q56N/Q58S/V196S (Q96N/Q98S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCNNSGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 8 - protein, 488 aa, Artificial Sequence
  Factor X K62N/G64S/V196S (K102N/G104S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCNDSLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 9 - protein, 488 aa, Artificial Sequence
  Factor X L65N/E67S/V196S (L105N/E107S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGNGSYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 10 - protein, 488 aa, Artificial Sequence
  Factor X E67N/V196S (E107N/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGNYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 11 - protein, 488 aa, Artificial Sequence
  Factor X L73N/G75S/V196S (L113N/G115S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCNESFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 12 - protein, 488 aa, Artificial Sequence
  Factor X G75N/E77S/V196S Prepropeptide (G115N/E117S/V236S)
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLENFSGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 13 - protein, 488 aa, Artificial Sequence
  Factor X R86N/L88S/V196S (R126N/L128S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTNKSCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 14 - protein, 488 aa, Artificial Sequence
  Factor X G114N/V196S (G154N/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 15 - protein, 488 aa, Artificial Sequence
  Factor X D95N/D97S/V196S (D135N/D137S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGNCSQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 16 - protein, 488 aa, Artificial Sequence
  Factor X E82S/V196S (E122S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCSLFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 17 - protein, 488 aa, Artificial Sequence
  Factor X E82N/F84S/V196S (E122N/F124S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCNLSTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 18 - protein, 488 aa, Artificial Sequence
  Factor X G78N/N80S/V196S (G118N/N120S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFENKSCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 19 - protein, 488 aa, Artificial Sequence
  Factor X E77N/K79S/V196S (E117N/K119S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFNGSNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 20 - protein, 488 aa, Artificial Sequence
  Factor X D119N/G121S/V196S (D159N/G161S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 21 - protein, 488 aa, Artificial Sequence
  Factor X L83N/V196S (L123N/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCENFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 22 - protein, 488 aa, Artificial Sequence
  Factor X K122S/V196S (K162S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGSACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 23 - protein, 488 aa, Artificial Sequence
  Factor X E51N/V196S (E91N/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCNTSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 24 - protein, 488 aa, Artificial Sequence
  Factor X Q58N/K60S/V196S (Q98N/K100S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNNGSCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 25 - protein, 488 aa, Artificial Sequence
  Factor X G114N/D119N/G121S/V196S (G154N/D159N/G161S/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 26 - protein, 488 aa, Artificial Sequence
  Factor X G198A (G238A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGAQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 27 - protein, 488 aa, Artificial Sequence
  Factor X G198V (G238V) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGVQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 28 - protein, 488 aa, Artificial Sequence
  Factor X G198R (G238R) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGRQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 29 - protein, 488 aa, Artificial Sequence
  Factor X G198K (G238K) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGKQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 30 - protein, 488 aa, Artificial Sequence
  Factor X G198P (G238P) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGPQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 31 - protein, 488 aa, Artificial Sequence
  Factor X G198H (G238H) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGHQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 32 - protein, 488 aa, Artificial Sequence
  Factor X L211S/G219H (L251S/G259H) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 33 - protein, 488 aa, Artificial Sequence
  Factor X G197P (G237P) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVPGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 34 - protein, 488 aa, Artificial Sequence
  Factor X D378N (D418N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGNSGGPHVTRFKDTYFVTGIVSWGEGCARKGKYGIYTKVTAFLKWIDRSMKTRGLPKAKSHAPEVITSSPLK

SEQ ID NO: 35 - protein, 488 aa, Artificial Sequence
  Factor X D378S (D418S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGSSGGPHVTRFKDTYFVTGIVSWGEGCARKGKYGIYTKVTAFLKWIDRSMKTRGLPKAKSHAPEVITSSPLK

SEQ ID NO: 36 - protein, 488 aa, Artificial Sequence
  Factor X V196L (V236L) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRILGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 37 - protein, 488 aa, Artificial Sequence
  Factor X V196T (V236T) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRITGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 38 - protein, 488 aa, Artificial Sequence
  Factor X V196P (V236P) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIPGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 39 - protein, 488 aa, Artificial Sequence
  Factor X G197V (G237V) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVVGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 40 - protein, 488 aa, Artificial Sequence
  Factor X G197T (G237T) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVTGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 41 - protein, 488 aa, Artificial Sequence
  Factor X G197S (G237S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVSGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 42 - protein, 488 aa, Artificial Sequence
  Factor X E200A (E240A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQACKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 43 - protein, 488 aa, Artificial Sequence
  Factor X E200S (E240S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQSCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 44 - protein, 488 aa, Artificial Sequence
  Factor X E200V (E240V) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQVCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 45 - protein, 488 aa, Artificial Sequence
  Factor X K202S (K242S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECSDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 46 - protein, 488 aa, Artificial Sequence
  Factor X R326A (R366A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGATHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 47 - protein, 488 aa, Artificial Sequence
  Factor X R326S (R366S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGSTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 48 - protein, 488 aa, Artificial Sequence
  Factor X R326T (R366T) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGTTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 49 - protein, 488 aa, Artificial Sequence
  Factor X R326V (R366V) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGVTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 50 - protein, 488 aa, Artificial Sequence
  Factor X R326Q (R366Q) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGQTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 51 - protein, 488 aa, Artificial Sequence
  Factor X R326N (R366N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGNTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 52 - protein, 488 aa, Artificial Sequence
  Factor X R326M (R366M) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGMTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 53 - protein, 488 aa, Artificial Sequence
  Factor X R326K (R366K) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGKTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 54 - protein, 488 aa, Artificial Sequence
  Factor X R326Y (R366Y) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGYTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 55 - protein, 488 aa, Artificial Sequence
  Factor X T327A (T367A)Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLALKTPITFRMNVAPACLPERDWAESTLMTQKTGIVSGFGRAHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 56 - protein, 488 aa, Artificial Sequence
  Factor X T327L (T367L) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 57 - protein, 488 aa, Artificial Sequence
  Factor X S334A (S374A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQATRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 58 - protein, 488 aa, Artificial Sequence
  Factor X S334T (S374T) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQTTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 59 - protein, 488 aa, Artificial Sequence
  Factor X S334N (S374N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQNTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 60 - protein, 488 aa, Artificial Sequence
  Factor X R336E (R376E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTELKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 61 - protein, 488 aa, Artificial Sequence
  Factor X K338A (K378A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLAMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 62 - protein, 488 aa, Artificial Sequence
  Factor X K338S (K378S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLSMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 63 - protein, 488 aa, Artificial Sequence
  Factor X K338N (K378N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLNMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 64 - protein, 488 aa, Artificial Sequence
  Factor X K338R (K378R) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLRMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 65 - protein, 488 aa, Artificial Sequence
  Factor X K338V (K378V) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLVMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 66 - protein, 488 aa, Artificial Sequence
  Factor X K338Y (K378Y) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLYMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 67 - protein, 488 aa, Artificial Sequence
  Factor X K338M (K378M) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 68 - protein, 488 aa, Artificial Sequence
  Factor X T327A/K338A (T367A/K378A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRAHEKGRQSTRLAMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 69 - protein, 488 aa, Artificial Sequence
  Factor X T327L/K338M (T367L/K378M) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQSTRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 70 - protein, 488 aa, Artificial Sequence
  Factor X E200V/T327L/K338M (E240V/T367L/K378M) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQVCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQSTRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 71 - protein, 488 aa, Artificial Sequence
  Factor X E200V/T327L/S334A/K338M (E240V/T367L/S374A/K378M) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQVCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQATRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 72 - protein, 488 aa, Artificial Sequence
  Factor X V196S/G197A (V236S/G237A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISAGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 73 - protein, 488 aa, Artificial Sequence
  Factor X V196S/L211S/G219H (V236S/L251S/G259H) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 74 - protein, 488 aa, Artificial Sequence
  Factor X D119N/G121S/V196S/L211S/G219H (D159N/G161S/V236S/L251S/G259H) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 75 - protein, 488 aa, Artificial Sequence
  Factor X G114N/V196S/L211S/G219H (G154N/V236S/L251S/G259H) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 76 - protein, 488 aa, Artificial Sequence
  Factor X G114N/D119N/G121S/V196S/L211S/G219H (G154N/D159N/G161S/V236S/L251S/G259H) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 77 - protein, 488 aa, Artificial Sequence
  Factor X G197A/L211S/G219H (G237A/L251S/G259H) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVAGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 78 - protein, 488 aa, Artificial Sequence
  Factor X V196S/G197A/L211S/G219H (V236S/G237A/L251S/G259H) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISAGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 79 - protein, 488 aa, Artificial Sequence
  Factor X I195L/V196S (I235L/V236S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLSGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 80 - protein, 488 aa, Artificial Sequence
  Factor X I195L/G197A (I235L/G237A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLVAGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 81 - protein, 488 aa, Artificial Sequence
  Factor X I195L/L211S/G219H (I235L/L251S/G259H) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLVGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 82 - protein, 488 aa, Artificial Sequence
  Factor X V196S/N214D (V236S/N254D) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLIDEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 83 - protein, 488 aa, Artificial Sequence
  Factor X V196S/N214A (V236S/N254A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLIAEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 84 - protein, 488 aa, Artificial Sequence
  Factor X V196S/N214S (V236S/N254S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLISEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 85 - protein, 488 aa, Artificial Sequence
  Factor X V196S/E216R (V236S/E256R) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINERNEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 86 - protein, 488 aa, Artificial Sequence
  Factor X V196S/E216K (V236S/E256K) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEKNEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 87 - protein, 488 aa, Artificial Sequence
  Factor X V196S/E216A (V236S/E256A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEANEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 88 - protein, 488 aa, Artificial Sequence
  Factor X V196S/E216S (V236S/E256S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINESNEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 89 - protein, 488 aa, Artificial Sequence
  Factor X V196S/E218R (V236S/E258R) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENRGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 90 - protein, 488 aa, Artificial Sequence
  Factor X V196S/E218K (V236S/E258K) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENKGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 91 - protein, 488 aa, Artificial Sequence
  Factor X V196S/E218A (V236S/E258A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENAGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 92 - protein, 488 aa, Artificial Sequence
  Factor X V196S/R332A (V236S/R372A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGAQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 93 - protein, 488 aa, Artificial Sequence
  Factor X V196S/R332D (V236S/R372D) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGDQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 94 - protein, 488 aa, Artificial Sequence
  Factor X V196S/R332E (V236S/R372E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGEQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 95 - protein, 488 aa, Artificial Sequence
  Factor X V196S/R332S (V236S/R372S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGSQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 96 - protein, 488 aa, Artificial Sequence
  Factor X V196S/R332G (V236S/R372G) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGGQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 97 - protein, 488 aa, Artificial Sequence
  Factor X V196S/R326E (V236S/R366E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGETHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 98 - protein, 488 aa, Artificial Sequence
  Factor X V196S/R326D (V236S/R366D) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGDTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 99 - protein, 488 aa, Artificial Sequence
  Factor X V196S/R326M (V236S/R366M) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGMTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 100 - protein, 488 aa, Artificial Sequence
  Factor X V196S/R326N (V236S/R366N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGNTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 101 - protein, 488 aa, Artificial Sequence
  Factor X V196S/R326Q (V236S/R366Q) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGQTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 102 - protein, 488 aa, Artificial Sequence
  Factor X V196S/R273E (V236S/R313E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNEFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 103 - protein, 488 aa, Artificial Sequence
  Factor X V196S/R273A (V236S/R313A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNAFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 104 - protein, 488 aa, Artificial Sequence
  Factor X V196S/R424A (V236S/R464A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDASMKTRGLPKAKSHAPEVITSSPLK

SEQ ID NO: 105 - protein, 488 aa, Artificial Sequence
  Factor X V196S/R424E (V236S/R464E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDESMKTRGLPKAKSHAPEVITSSPLK

SEQ ID NO: 106 - protein, 488 aa, Artificial Sequence
  Factor X V196S/K420A (V236S/K460A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLAWIDRSMKTRGLPKAKSHAPEVITSSPLK

SEQ ID NO: 107 - protein, 488 aa, Artificial Sequence
  Factor X V196S/K420E (V236S/K460E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLEWIDRSMKTRGLPKAKSHAPEVITSSPLK

SEQ ID NO: 108 - protein, 488 aa, Artificial Sequence
  Factor X V196S/R306E (V236S/R346E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPEEDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 109 - protein, 488 aa, Artificial Sequence
  Factor X V196S/K276A (V236S/K316A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTAETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 110 - protein, 488 aa, Artificial Sequence
  Factor X V196S/K276E (V236S/K316E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTEETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 111 - protein, 488 aa, Artificial Sequence
  Factor X V196S/K420E/R424E (V236S/K460E/R464E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLEWIDESMKTRGLPKAKSHAPEVITSSPLK

SEQ ID NO: 112 - protein, 488 aa, Artificial Sequence
  Factor X V196S/R273E/K420E/R424E (V236S/R313E/K460E/R464E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNEFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLEWIDESMKTRGLPKAKSHAPEVITSSPLK

SEQ ID NO: 113 - protein, 488 aa, Artificial Sequence
  Factor X V196S/R273E/R306E/K420E/R424E (V236S/R313E/R346E/K460E/R464E) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNEFTKETYDFDIAVLRLKTPITFRMNVAPACLPEEDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLEWIDESMKTRGLPKAKSHAPEVITSSPLK

SEQ ID NO: 114 - protein, 488 aa, Artificial Sequence
  Factor X V196S/K338A (V236S/K378A) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLAMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 115 - protein, 488 aa, Artificial Sequence
  Factor X V196S/K338S (V236S/K378S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLSMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 116 - protein, 488 aa, Artificial Sequence
  Factor X V196S/E215N/N217S (V236S/E255N/N257S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINNESEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 117 - protein, 488 aa, Artificial Sequence
  Factor X V196S/E264N/E266S (V236S/E304N/N306S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 118 - protein, 488 aa, Artificial Sequence
  Factor X D119N/G121S/V196S/E264N/E266S (D159N/G161S/V236S/E304N/N306S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 119 - protein, 488 aa, Artificial Sequence
  Factor X G114N/V196S/E264N/E266S (G154N/V236S/E304N/N306S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 120 - protein, 488 aa, Artificial Sequence
  Factor X V196S/R429N/L431S (V236S/R469N/L471S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTNGSPKAKSHAPEVITSSPLK

SEQ ID NO: 121 - protein, 488 aa, Artificial Sequence
  Factor X V196S/R243N/K245S (V236S/R283N/K285S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKNFSVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 122 - protein, 488 aa, Artificial Sequence
  Factor X V196S/T293N/R295S (V236S/T333N/R335S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPINFSMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 123 - protein, 488 aa, Artificial Sequence
  Factor X V196S/D389N/Y391S (V236S/D429N/Y431S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKNTSFVTGIVSWGEGCARKGKYGIYTKVTAFLKWIDRSMKTRGLPKAKSHAPEVITSSPLK

SEQ ID NO: 124 - protein, 488 aa, Artificial Sequence
  Factor X V196S/K388N (V236S/K428N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 125 - protein, 488 aa, Artificial Sequence
  Factor X D119N/G121S/V196S/K388N (D159N/G161S/V236S/K428N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 126 - protein, 488 aa, Artificial Sequence
  Factor X V196S/T428N/G430S (V236S/T468N/G470S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKNRSLPKAKSHAPEVITSSPLK

SEQ ID NO: 127 - protein, 488 aa, Artificial Sequence
  Factor X V196S/L211S/G219H/E264N/E266S (V236S/L251S/G259H/E304NE306S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 128 - protein, 488 aa, Artificial Sequence
  Factor X D119N/G121S/V196S/L211S/G219H/E264N/E266S (D159N/G161S/V236S/L251S/G259H/E304N/E306S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 129 - protein, 488 aa, Artificial Sequence
  Factor X G114N/V196S/L211S/G219H/E264N/E266S (G154N/V236S/L251S/G259H/E304N/E306S) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 130 - protein, 488 aa, Artificial Sequence
  Factor X V196S/E264N/E266S/K388N (V236S/E304N/E306S/K428N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 131 - protein, 488 aa, Artificial Sequence
  Factor X D119N/G121S/V196S/L211S/G219H/K388N (D159N/G161S/V236S/L251S/G259H/K428N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 132 - protein, 488 aa, Artificial Sequence
  Factor X G114N/V196S/L211S/G219H/K388N (G154N/V236S/L251S/G259H/K428N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 133 - protein, 488 aa, Artificial Sequence
  Factor X V196S/L211S/G219H/E264N/E266S/K388N (V236S/L251S/G259H/E304N/E306S/K428N) Prepropeptide
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 134 - protein, 448 aa, Homo sapiens [sequence omitted]

SEQ ID NO: 135 - protein, 448 aa, Artificial Sequence; identical to SEQ ID NO: 3
  Mature Factor X I195L

SEQ ID NO: 136 - protein, 448 aa, Artificial Sequence
  Mature Factor X V196I
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIIGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 137 - protein, 448 aa, Artificial Sequence
  Mature Factor X V196S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 138 - protein, 448 aa, Artificial Sequence
  Mature Factor X T85N/K87S/V196S
ANSFLEEMKKGHLERECMEETCSYEEAREVFEDSDKTNEFWNKYKDGDQCETSPCQNQGKCKDGLGEYTCTCLEGFEGKNCELFNRSLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 139 - protein, 448 aa, Artificial Sequence
  Mature Factor X Q56N/Q58S/V196S
ANSFLEEMKKGHLERECMEETCSYEEAREVFEDSDKTNEFWNKYKDGDQCETSPCNNSGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 140 - protein, 448 aa, Artificial Sequence
  Mature Factor X K62N/G64S/V196S
ANSFLEEMKKGHLERECMEETCSYEEAREVFEDSDKTNEFWNKYKDGDQCETSPCQNQGKCNDSLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 141 - protein, 448 aa, Artificial Sequence
  Mature Factor X L65N/E67S/V196S
ANSFLEEMKKGHLERECMEETCSYEEAREVFEDSDKTNEFWNKYKDGDQCETSPCQNQGKCKDGNGSYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 142 - protein, 448 aa, Artificial Sequence
  Mature Factor X E67N/V196S
ANSFLEEMKKGHLERECMEETCSYEEAREVFEDSDKTNEFWNKYKDGDQCETSPCQNQGKCKDGLGNYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 143 - protein, 448 aa, Artificial Sequence
  Mature Factor X L73N/G75S/V196S
ANSFLEEMKKGHLERECMEETCSYEEAREVFEDSDKTNEFWNKYKDGDQCETSPCQNQGKCKDGLGEYTCTCNESFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 144 - protein, 448 aa, Artificial Sequence
  Mature Factor X G75N/E77S/V196S
ANSFLEEMKKGHLERECMEETCSYEEAREVFEDSDKTNEFWNKYKDGDQCETSPCQNQGKCKDGLGEYTCTCLENFSGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 145 - protein, 448 aa, Artificial Sequence
  Mature Factor X R86N/L88S/V196S
ANSFLEEMKKGHLERECMEETCSYEEAREVFEDSDKTNEFWNKYKDGDQCETSPCQNQGKCKDGLGEYTCTCLEGFEGKNCELFTNKSCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 146 - protein, 448 aa, Artificial Sequence
  Mature Factor X G114N/V196S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 147 - protein, 448 aa, Artificial Sequence
  Mature Factor X D95N/D97S/V196S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGNCSQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 148 - protein, 448 aa, Artificial Sequence
  Mature Factor X E82S/V196S
ANSFLEEMKKGHLERECMEETCSYEEAREVFEDSDKTNEFWNKYKDGDQCETSPCQNQGKCKDGLGEYTCTCLEGFEGKNCSLFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 149 - protein, 448 aa, Artificial Sequence
  Mature Factor X E82N/F84S/V196S
ANSFLEEMKKGHLERECMEETCSYEEAREVFEDSDKTNEFWNKYKDGDQCETSPCQNQGKCKDGLGEYTCTCLEGFEGKNCNLSTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 150 - protein, 448 aa, Artificial Sequence
  Mature Factor X G78N/N80S/V196S
ANSFLEEMKKGHLERECMEETCSYEEAREVFEDSDKTNEFWNKYKDGDQCETSPCQNQGKCKDGLGEYTCTCLEGFENKSCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 151 - protein, 448 aa, Artificial Sequence
  Mature Factor X E77N/K79S/V196S
ANSFLEEMKKGHLERECMEETCSYEEAREVFEDSDKTNEFWNKYKDGDQCETSPCQNQGKCKDGLGEYTCTCLEGFNGSNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 152 - protein, 448 aa, Artificial Sequence
  Mature Factor X D119N/G121S/V196S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 153 - protein, 448 aa, Artificial Sequence
  Mature Factor X L83N/V196S
ANSFLEEMKKGHLERECMEETCSYEEAREVFEDSDKTNEFWNKYKDGDQCETSPCQNQGKCKDGLGEYTCTCLEGFEGKNCENFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 154 - protein, 448 aa, Artificial Sequence
  Mature Factor X K122S/V196S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGSACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 155 - protein, 448 aa, Artificial Sequence
  Mature Factor X E51N/V196S
ANSFLEEMKKGHLERECMEETCSYEEAREVFEDSDKTNEFWNKYKDGDQCNTSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 156 - protein, 448 aa, Artificial Sequence
  Mature Factor X Q58N/K60S/V196S
ANSFLEEMKKGHLERECMEETCSYEEAREVFEDSDKTNEFWNKYKDGDQCETSPCQNNGSCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 157 - protein, 448 aa, Artificial Sequence
  Mature Factor X G114N/D119N/G121S/V196S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 158 - protein, 448 aa, Artificial Sequence
  Mature Factor X G198A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGAQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 159 - protein, 448 aa, Artificial Sequence
  Mature Factor X G198V
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGVQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 160 - protein, 448 aa, Artificial Sequence
  Mature Factor X G198R
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGRQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 161 - protein, 448 aa, Artificial Sequence
  Mature Factor X G198K
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGKQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 162 - protein, 448 aa, Artificial Sequence
  Mature Factor X G198P
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGPQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 163 - protein, 448 aa, Artificial Sequence
  Mature Factor X G198H
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGHQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 164 - protein, 448 aa, Artificial Sequence
  Mature Factor X L211S/G219H
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 165 - protein, 448 aa, Artificial Sequence
  Mature Factor X G197P
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVPGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 166 - protein, 448 aa, Artificial Sequence
  Mature Factor X D378N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGNSGGPHVTRFKDTYFVTGIVSWGEGCARKGKYGIYTKVTAFLKWIDRSMKTRGLPKAKSHAPEVITSSPLK

SEQ ID NO: 167 - protein, 448 aa, Artificial Sequence
  Mature Factor X D378S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGSSGGPHVTRFKDTYFVTGIVSWGEGCARKGKYGIYTKVTAFLKWIDRSMKTRGLPKAKSHAPEVITSSPLK

SEQ ID NO: 168 - protein, 448 aa, Artificial Sequence
  Mature Factor X V196L
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRILGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 169 - protein, 448 aa, Artificial Sequence
  Mature Factor X V196T
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRITGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 170 - protein, 448 aa, Artificial Sequence
  Mature Factor X V196P
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIPGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 171 - protein, 448 aa, Artificial Sequence
  Mature Factor X G197V
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVVGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 172 - protein, 448 aa, Artificial Sequence
  Mature Factor X G197T
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVTGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 173 - protein, 448 aa, Artificial Sequence
  Mature Factor X G197S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVSGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 174 - protein, 448 aa, Artificial Sequence
  Mature Factor X E200A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQACKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 175 - protein, 448 aa, Artificial Sequence
  Mature Factor X E200S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQSCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 176 - protein, 448 aa, Artificial Sequence
  Mature Factor X E200V
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQVCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 177 - protein, 448 aa, Artificial Sequence
  Mature Factor X K202S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECSDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 178 - protein, 448 aa, Artificial Sequence
  Mature Factor X R326A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGATHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 179 - protein, 448 aa, Artificial Sequence
  Mature Factor X R326S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGSTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 180 - protein, 448 aa, Artificial Sequence
  Mature Factor X R326T
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGTTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 181 - protein, 448 aa, Artificial Sequence
  Mature Factor X R326V
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGVTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 182 - protein, 448 aa, Artificial Sequence
  Mature Factor X R326Q
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGQTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 183 - protein, 448 aa, Artificial Sequence
  Mature Factor X R326N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGNTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 184 - protein, 448 aa, Artificial Sequence
  Mature Factor X R326M
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGMTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 185 - protein, 448 aa, Artificial Sequence
  Mature Factor X R326K
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGKTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 186 - protein, 448 aa, Artificial Sequence
  Mature Factor X R326Y
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGYTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 187 - protein, 448 aa, Artificial Sequence
  Mature Factor X T327A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLALKTPITFRMNVAPACLPERDWAESTLMTQKTGIVSGFGRAHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 188 - protein, 448 aa, Artificial Sequence
  Mature Factor X T327L
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 189 - protein, 448 aa, Artificial Sequence
  Mature Factor X S334A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQATRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 190 - protein, 448 aa, Artificial Sequence
  Mature Factor X S334T
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQTTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 191 - protein, 448 aa, Artificial Sequence
  Mature Factor X S334N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQNTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 192 - protein, 448 aa, Artificial Sequence
  Mature Factor X R336E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTELKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 193 - protein, 448 aa, Artificial Sequence
  Mature Factor X K338A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLAMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 194 - protein, 448 aa, Artificial Sequence
  Mature Factor X K338S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLSMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 195 - protein, 448 aa, Artificial Sequence
  Mature Factor X K338N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLNMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 196 - protein, 448 aa, Artificial Sequence
  Mature Factor X K338R
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLRMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 197 - protein, 448 aa, Artificial Sequence
  Mature Factor X K338V
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLVMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 198 - protein, 448 aa, Artificial Sequence
  Mature Factor X K338Y
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLYMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 199 - protein, 448 aa, Artificial Sequence
  Mature Factor X K338M
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 200 - protein, 448 aa, Artificial Sequence
  Mature Factor X T327A/K338A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRAHEKGRQSTRLAMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 201 - protein, 448 aa, Artificial Sequence
  Mature Factor X T327L/K338M
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQSTRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 202 - protein, 448 aa, Artificial Sequence
  Mature Factor X E200V/T327L/K338M
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQVCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQSTRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 203 - protein, 448 aa, Artificial Sequence
  Mature Factor X E200V/T327L/S334A/K338M
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQVCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQATRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 204 - protein, 448 aa, Artificial Sequence
  Mature Factor X V196S/G197A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISAGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 205 - protein, 448 aa, Artificial Sequence
  Mature Factor X V196S/L211S/G219H
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 206 - protein, 448 aa, Artificial Sequence
  Mature Factor X D119N/G121S/V196S/L211S/G219H
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 207 - protein, 448 aa, Artificial Sequence
  Mature Factor X G114N/V196S/L211S/G219H
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 208 - protein, 448 aa, Artificial Sequence
  Mature Factor X G114N/D119N/G121S/V196S/L211S/G219H
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 209 - protein, 448 aa, Artificial Sequence
  Mature Factor X G197A/L211S/G219H
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVAGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 210 - protein, 448 aa, Artificial Sequence
  Mature Factor X V196S/G197A/L211S/G219H
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISAGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 211 - protein, 448 aa, Artificial Sequence
  Mature Factor X I195L/V196S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLSGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 212 - protein, 448 aa, Artificial Sequence
  Mature Factor X I195L/G197A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLVAGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 213 - protein, 448 aa, Artificial Sequence
  Mature Factor X I195L/L211S/G219H
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLVGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 214 - protein, 448 aa, Artificial Sequence
  Mature Factor X V196S/N214D
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLIDEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 215 - protein, 448 aa, Artificial Sequence
  Mature Factor X V196S/N214A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLIAEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 216 - protein, 448 aa, Artificial Sequence
  Mature Factor X V196S/N214S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLISEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 217 - protein, 448 aa, Artificial Sequence
  Mature Factor X V196S/E216R
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINERNEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 218 - protein, 448 aa, Artificial Sequence
  Mature Factor X V196S/E216K
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEKNEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 219 - protein, 448 aa, Artificial Sequence
  Mature Factor X V196S/E216A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEANEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 220 - protein, 448 aa, Artificial Sequence
  Mature Factor X V196S/E216S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINESNEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 221 - protein, 448 aa, Artificial Sequence
  Mature Factor X V196S/E218R
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENRGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 222 - protein, 448 aa, Artificial Sequence
  Mature Factor X V196S/E218K
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENKGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 223 - protein, 448 aa, Artificial Sequence
  Mature Factor X V196S/E218A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENAGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 224 - protein, 448 aa, Artificial Sequence
  Mature Factor X V196S/R332A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGAQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 225 - protein, 448 aa, Artificial Sequence
  Mature Factor X V196S/R332D
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGDQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 226 - protein, 448 aa, Artificial Sequence
  Mature Factor X V196S/R332E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGEQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 227 - protein, 448 aa, Artificial Sequence
  Mature Factor X V196S/R332S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGSQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 228 - protein, 448 aa, Artificial Sequence
  Mature Factor X V196S/R332G
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGGQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 229 - protein, 448 aa, Artificial Sequence
  Mature Factor X V196S/R326E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGETHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 230 - protein, 448 aa, Artificial Sequence
  Mature Factor X V196S/R326D
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGDTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 231 - protein, 448 aa, Artificial Sequence
  Mature Factor X V196S/R326M
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGMTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 232 - protein, 448 aa, Artificial Sequence
  Mature Factor X V196S/R326N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGNTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 233 - protein, 448 aa, Artificial Sequence
  Mature Factor X V196S/R326Q
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGQTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 234 - protein, 448 aa, Artificial Sequence
  Mature Factor X V196S/R273E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNEFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 235 - protein, 448 aa, Artificial Sequence
  Mature Factor X V196S/R273A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNAFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 236 - protein, 448 aa, Artificial Sequence
  Mature Factor X V196S/R424A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDASMKTRGLPKAKSHAPEVITSSPLK

SEQ ID NO: 237 - protein, 448 aa, Artificial Sequence
  Mature Factor X V196S/R424E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDESMKTRGLPKAKSHAPEVITSSPLK

SEQ ID NO: 238 - protein, 448 aa, Artificial Sequence
  Mature Factor X V196S/K420A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLAWIDRSMKTRGLPKAKSHAPEVITSSPLK

SEQ ID NO: 239 - protein, 448 aa, Artificial Sequence
  Mature Factor X V196S/K420E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSEGPHVTRFKDTYFVTGIVSWGEGCARKGKYGIYTKVTAFLEWIDRSMKTRGLPKAKSHAPEVITSSPLK

SEQ ID NO: 240 - protein, 448 aa, Artificial Sequence
  Mature Factor X V196S/R306E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPEEDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 241 - protein, 448 aa, Artificial Sequence
  Mature Factor X V196S/K276A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTAETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 242 - protein, 448 aa, Artificial Sequence
  Mature Factor X V196S/K276E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTEETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 243 - protein, 448 aa, Artificial Sequence
  Mature Factor X V196S/K420E/R424E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLEWIDESMKTRGLPKAKSHAPEVITSSPLK

SEQ ID NO: 244 - protein, 448 aa, Artificial Sequence
  Mature Factor X V196S/R273E/K420E/R424E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNEFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLEWIDESMKTRGLPKAKSHAPEVITSSPLK

SEQ ID NO: 245 - protein, 448 aa, Artificial Sequence
  Mature Factor X V196S/R273E/R306E/K420E/R424E
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNEFTKETYDFDIAVLRLKTPITFRMNVAPACLPEEDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLEWIDESMKTRGLPKAKSHAPEVITSSPLK

SEQ ID NO: 246 - protein, 448 aa, Artificial Sequence
  Mature Factor X V196S/K338A
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLAMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 247 - protein, 448 aa, Artificial Sequence
  Mature Factor X V196S/K338S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLSMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 248 - protein, 448 aa, Artificial Sequence
  Mature Factor X V196S/E215N/N217S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINNESEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 249 - protein, 448 aa, Artificial Sequence
  Mature Factor X V196S/E264N/E266S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 250 - protein, 448 aa, Artificial Sequence
  Mature Factor X D119N/G121S/V196S/E264N/E266S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 251 - protein, 448 aa, Artificial Sequence
  Mature Factor X G114N/V196S/E264N/E266S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 252 - protein, 448 aa, Artificial Sequence
  Mature Factor X V196S/R429N/L431S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTNGSPKAKSHAPEVITSSPLK

SEQ ID NO: 253 - protein, 448 aa, Artificial Sequence
  Mature Factor X V196S/R243N/K245S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKNFSVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 254 - protein, 448 aa, Artificial Sequence
  Mature Factor X V196S/T293N/R295S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPINFSMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 255 - protein, 448 aa, Artificial Sequence
  Mature Factor X V196S/D389N/Y391S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKNTSFVTGIVSWGEGCARKGKYGIYTKVTAFLKWIDRSMKTRGLPKAKSHAPEVITSSPLK

SEQ ID NO: 256 - protein, 448 aa, Artificial Sequence
  Mature Factor X V196S/K388N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 257 - protein, 448 aa, Artificial Sequence
  Mature Factor X D119N/G121S/V196S/K388N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 258 - protein, 448 aa, Artificial Sequence
  Mature Factor X V196S/T428N/G430S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKNRSLPKAKSHAPEVITSSPLK

SEQ ID NO: 259 - protein, 448 aa, Artificial Sequence
  Mature Factor X V196S/L211S/G219H/E264N/E266S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 260 - protein, 448 aa, Artificial Sequence
  Mature Factor X D119N/G121S/V196S/L211S/G219H/E264N/E266S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 261 - protein, 448 aa, Artificial Sequence
  Mature Factor X G114N/V196S/L211S/G219H/E264N/E266S
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 262 - protein, 448 aa, Artificial Sequence
  Mature Factor X V196S/E264N/E266S/K388N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 263 - protein, 448 aa, Artificial Sequence
  Mature Factor X D119N/G121S/V196S/L211S/G219H/K388N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 264 - protein, 448 aa, Artificial Sequence
  Mature Factor X G114N/V196S/L211S/G219H/K388N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 265 - protein, 448 aa, Artificial Sequence
  Mature Factor X V196S/L211S/G219H/E264N/E266S/K388N
ANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 266 - DNA, 4194 bp, Artificial Sequence
  pFUSE-hIgG1-Fc2 vector
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcgatatcggccatggttagatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgagtgctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 267 - DNA, 25 bp, Artificial Sequence
  pFUSE-Acc-F1 forward primer
gtgctagctggccagacatgataag

SEQ ID NO: 268 - DNA, 27 bp, Artificial Sequence
  pFUSE-Acc-R3 reverse primer
catggtggccctccttcgccggtgatc

SEQ ID NO: 269 - DNA, 36 bp, Artificial Sequence
  FX-wtsp-Invivo-F1 forward primer
cgaaggagggccaccatggggcgcccactgcacctc

SEQ ID NO: 270 - DNA, 38 bp, Artificial Sequence
  FX-Invivo-R1 reverse primer
tgtctggccagctagcactcactttaatggagaggacg

SEQ ID NO: 271 - DNA, 24 bp, Artificial Sequence
  F10-Pro-Acc-F1 forward primer
gccaattcctttcttgaagagatg

SEQ ID NO: 272 - DNA, 27 bp, Artificial Sequence
  pFUSE-Acc-R3 reverse primer
catggtggccctccttcgccggtgatc

SEQ ID NO: 273 - protein, 622 aa, Homo sapiens
  Thrombin
  PROPEP (1)...(43)
  ref <308>: DATABASE ACCESSION NUMBER: UniProtKB/Swiss-Prot
  ref <309>: DATABASE ENTRY DATE: 2012-02-22
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 274 - DNA, 36 bp, Artificial Sequence
  FII-SP+Pro-F10Acc-F1 forward primer
cgaaggagggccaccatggcgcacgtccgaggcttg

SEQ ID NO: 275 - DNA, 39 bp, Artificial Sequence
  FII-SP+Pro-F10Acc-R1 reverse primer
ttcaagaaaggaattggctcgccggacccgctggagcag

SEQ ID NO: 276 - DNA, 39 bp, Artificial Sequence
  FX-I16L-For primer
gacaacaacctcaccaggctggtgggaggccaggaatgc

SEQ ID NO: 277 - DNA, 40 bp, Artificial Sequence
  FX-V17A-For primer
caacaacctcaccaggatcgccggaggccaggaatgcaag

SEQ ID NO: 278 - DNA, 34 bp, Artificial Sequence
  FX-V17I-For primer
caacctcaccaggatcatcggaggccaggaatgc

SEQ ID NO: 279 - DNA, 34 bp, Artificial Sequence
  FX-V17L-For primer
caacctcaccaggatcctgggaggccaggaatgc

SEQ ID NO: 280 - DNA, 34 bp, Artificial Sequence
  FX-V17T-For primer
caacctcaccaggatcaccggaggccaggaatgc

SEQ ID NO: 281 - DNA, 34 bp, Artificial Sequence
  FX-V17S-For primer
caacctcaccaggatcagcggaggccaggaatgc

SEQ ID NO: 282 - DNA, 34 bp, Artificial Sequence
  FX-V17P-For primer
caacctcaccaggatccccggaggccaggaatgc

SEQ ID NO: 283 - DNA, 33 bp, Artificial Sequence
  FX-G18A-For primer
accaggatcgtggccggccaggaatgcaaggac

SEQ ID NO: 284 - DNA, 33 bp, Artificial Sequence
  FX-G18P-For primer
accaggatcgtgcccggccaggaatgcaaggac

SEQ ID NO: 285 - DNA, 33 bp, Artificial Sequence
  FX-G18S-For primer
accaggatcgtgagcggccaggaatgcaaggac

SEQ ID NO: 286 - DNA, 33 bp, Artificial Sequence
  FX-G18V-For primer
accaggatcgtggtgggccaggaatgcaaggac

SEQ ID NO: 287 - DNA, 33 bp, Artificial Sequence
  FX-G18T-For primer
accaggatcgtgaccggccaggaatgcaaggac

SEQ ID NO: 288 - DNA, 34 bp, Artificial Sequence
  FX-G19A-For primer
caccaggatcgtgggagcccaggaatgcaaggac

SEQ ID NO: 289 - DNA, 34 bp, Artificial Sequence
  FX-G19V-For primer
caccaggatcgtgggagtgcaggaatgcaaggac

SEQ ID NO: 290 - DNA, 34 bp, Artificial Sequence
  FX-G19R-For primer
caccaggatcgtgggacggcaggaatgcaaggac

SEQ ID NO: 291 - DNA, 34 bp, Artificial Sequence
  FX-G19K-For primer
caccaggatcgtgggaaagcaggaatgcaaggac

SEQ ID NO: 292 - DNA, 34 bp, Artificial Sequence
  FX-G19P-For primer
caccaggatcgtgggaccccaggaatgcaaggac

SEQ ID NO: 293 - DNA, 34 bp, Artificial Sequence
  FX-G19H-For primer
caccaggatcgtgggacaccaggaatgcaaggac

SEQ ID NO: 294 - DNA, 33 bp, Artificial Sequence
  FX-G19N-For primer
gatgcctgccaggggaacagcgggggcccgcac

SEQ ID NO: 295 - DNA, 33 bp, Artificial Sequence
  FX-G19S-For primer
gatgcctgccaggggagcagcgggggcccgcac

SEQ ID NO: 296 - DNA, 58 bp, Artificial Sequence
  FX-L32S/G40H-For primer
gtgtccctggcaggccagcctcatcaatgaggaaaacgagcacttctgtggtggaacc

SEQ ID NO: 297 - DNA, 34 bp, Artificial Sequence
  FX-E21A-For primer
gatcgtgggaggccaggcctgcaaggacggggag

SEQ ID NO: 298 - DNA, 34 bp, Artificial Sequence
  FX-E21S-For primer
gatcgtgggaggccagagctgcaaggacggggag

SEQ ID NO: 299 - DNA, 34 bp, Artificial Sequence
  FX-E21V-For primer
gatcgtgggaggccaggtgtgcaaggacggggag

SEQ ID NO: 300 - DNA, 33 bp, Artificial Sequence
  FX-K23S-For primer
ggaggccaggaatgcagcgacggggagtgtccc

SEQ ID NO: 301 - DNA, 33 bp, Artificial Sequence
  FX-R143A-For primer
gtgagcggcttcggggccacccacgagaagggc

SEQ ID NO: 302 - DNA, 33 bp, Artificial Sequence
  FX-R143S-For primer
gtgagcggcttcgggagcacccacgagaagggc

SEQ ID NO: 303 - DNA, 33 bp, Artificial Sequence
  FX-R143T-For primer
gtgagcggcttcgggaccacccacgagaagggc

SEQ ID NO: 304 - DNA, 33 bp, Artificial Sequence
  FX-R143V-For primer
gtgagcggcttcggggtgacccacgagaagggc

SEQ ID NO: 305 - DNA, 33 bp, Artificial Sequence
  FX-R143Q-For primer
gtgagcggcttcgggcagacccacgagaagggc

SEQ ID NO: 306 - DNA, 33 bp, Artificial Sequence
  FX-R143N-For primer
gtgagcggcttcgggaacacccacgagaagggc

SEQ ID NO: 307 - DNA, 33 bp, Artificial Sequence
  FX-R143M-For primer
gtgagcggcttcgggatgacccacgagaagggc

SEQ ID NO: 308 - DNA, 33 bp, Artificial Sequence
  FX-R143K-For primer
gtgagcggcttcgggaagacccacgagaagggc

SEQ ID NO: 309 - DNA, 33 bp, Artificial Sequence
  FX-R143Y-For primer
gtgagcggcttcgggtacacccacgagaagggc

SEQ ID NO: 310 - DNA, 33 bp, Artificial Sequence
  FX-R143D-For primer
gtgagcggcttcggggacacccacgagaagggc

SEQ ID NO: 311 - DNA, 34 bp, Artificial Sequence
  FX-T144A-For primer
gagcggcttcgggcgcgcccacgagaagggccgg

SEQ ID NO: 312 - DNA, 34 bp, Artificial Sequence
  FX-T144L-For primer
gagcggcttcgggcgcctgcacgagaagggccgg

SEQ ID NO: 313 - DNA, 33 bp, Artificial Sequence
  FX-S152A-For primer
gagaagggccggcaggccaccaggctcaagatg

SEQ ID NO: 314 - DNA, 33 bp, Artificial Sequence
  FX-S152T-For primer
gagaagggccggcagaccaccaggctcaagatg

SEQ ID NO: 315 - DNA, 33 bp, Artificial Sequence
  FX-S152N-For primer
gagaagggccggcagaacaccaggctcaagatg

SEQ ID NO: 316 - DNA, 33 bp, Artificial Sequence
  FX-R154E-For primer
ggccggcagtccaccgagctcaagatgctggag

SEQ ID NO: 317 - DNA, 33 bp, Artificial Sequence
  FX-K156A-For primer
cagtccaccaggctcgccatgctggaggtgccc

SEQ ID NO: 318 - DNA, 33 bp, Artificial Sequence
  FX-K156S-For primer
cagtccaccaggctcagcatgctggaggtgccc

SEQ ID NO: 319 - DNA, 33 bp, Artificial Sequence
  FX-K156N-For primer
cagtccaccaggctcaacatgctggaggtgccc

SEQ ID NO: 320 - DNA, 33 bp, Artificial Sequence
  FX-K156D-For primer
cagtccaccaggctcgacatgctggaggtgccc

SEQ ID NO: 321 - DNA, 33 bp, Artificial Sequence
  FX-K156R-For primer
cagtccaccaggctcaggatgctggaggtgccc

SEQ ID NO: 322 - DNA, 33 bp, Artificial Sequence
  FX-K156V-For primer
cagtccaccaggctcgtgatgctggaggtgccc

SEQ ID NO: 323 - DNA, 33 bp, Artificial Sequence
  FX-K156Y-For primer
cagtccaccaggctctacatgctggaggtgccc

SEQ ID NO: 324 - DNA, 33 bp, Artificial Sequence
  FX-K156M-For primer
cagtccaccaggctcatgatgctggaggtgccc

SEQ ID NO: 325 - DNA, 37 bp, Artificial Sequence
  FX-V17S/G18A-For primer
caacctcaccaggatcagcgccggccaggaatgcaag

SEQ ID NO: 326 - DNA, 42 bp, Artificial Sequence
  FX-I16L/V17S-For primer
gacaacaacctcaccaggctgagcggaggccaggaatgcaag

SEQ ID NO: 327 - DNA, 45 bp, Artificial Sequence
  FX-I16L/G18A-For primer
gacaacaacctcaccaggctggtggccggccaggaatgcaaggac

SEQ ID NO: 328 - DNA, 45 bp, Artificial Sequence
  FX-S152A/K156M-For primer
gagaagggccggcaggccaccaggctcatgatgctggaggtgccc

SEQ ID NO: 329 - DNA, 45 bp, Artificial Sequence
  FX-N35D-For primer
ccctggcaggccctgctcatcgacgaggaaaacgagggtttctgt

SEQ ID NO: 330 - DNA, 45 bp, Artificial Sequence
  FX-N35A-For primer
ccctggcaggccctgctcatcgccgaggaaaacgagggtttctgt

SEQ ID NO: 331 - DNA, 45 bp, Artificial Sequence
  FX-N35S-For primer
ccctggcaggccctgctcatcagcgaggaaaacgagggtttctgt

SEQ ID NO: 332 - DNA, 45 bp, Artificial Sequence
  FX-E37R-For primer
caggccctgctcatcaatgagcgcaacgagggtttctgtggtgga

SEQ ID NO: 333 - DNA, 45 bp, Artificial Sequence
  FX-E37K-For primer
caggccctgctcatcaatgagaagaacgagggtttctgtggtgga

SEQ ID NO: 334 - DNA, 45 bp, Artificial Sequence
  FX-E37A-For primer
caggccctgctcatcaatgaggccaacgagggtttctgtggtgga

SEQ ID NO: 335 - DNA, 45 bp, Artificial Sequence
  FX-E37S-For primer
caggccctgctcatcaatgagagcaacgagggtttctgtggtgga

SEQ ID NO: 336 - DNA, 45 bp, Artificial Sequence
  FX-E39R-For primer
ctgctcatcaatgaggaaaaccgcggtttctgtggtggaactatt

SEQ ID NO: 337 - DNA, 45 bp, Artificial Sequence
  FX-E39K-For primer
ctgctcatcaatgaggaaaacaagggtttctgtggtggaactatt

SEQ ID NO: 338 - DNA, 45 bp, Artificial Sequence
  FX-E39A-For primer
ctgctcatcaatgaggaaaacgccggtttctgtggtggaactatt

SEQ ID NO: 339 - DNA, 45 bp, Artificial Sequence
  FX-R150A-For primer
gggcgcacccacgagaagggcgcccagtccaccaggctcaagatg

SEQ ID NO: 340 - DNA, 45 bp, Artificial Sequence
  FX-R150D-For primer
gggcgcacccacgagaagggcgaccagtccaccaggctcaagatg

SEQ ID NO: 341 - DNA, 45 bp, Artificial Sequence
  FX-R150E-For primer
gggcgcacccacgagaagggcgagcagtccaccaggctcaagatg

SEQ ID NO: 342 - DNA, 45 bp, Artificial Sequence
  FX-R150S-For primer
gggcgcacccacgagaagggcagccagtccaccaggctcaagatg

SEQ ID NO: 343 - DNA, 45 bp, Artificial Sequence
  FX-R150G-For primer
gggcgcacccacgagaagggcggccagtccaccaggctcaagatg

SEQ ID NO: 344 - DNA, 45 bp, Artificial Sequence
  FX-R143E-For primer
gggattgtgagcggcttcggggagacccacgagaagggccggcag

SEQ ID NO: 345 - DNA, 45 bp, Artificial Sequence
  FX-R143D-For primer
gggattgtgagcggcttcggggacacccacgagaagggccggcag

SEQ ID NO: 346 - DNA, 45 bp, Artificial Sequence
  FX-R143M-For primer
gggattgtgagcggcttcgggatgacccacgagaagggccggcag

SEQ ID NO: 347 - DNA, 45 bp, Artificial Sequence
  FX-R143N-For primer
gggattgtgagcggcttcgggaacacccacgagaagggccggcag

SEQ ID NO: 348 - DNA, 45 bp, Artificial Sequence
  FX-R143Q-For primer
gggattgtgagcggcttcgggcagacccacgagaagggccggcag

SEQ ID NO: 349 - DNA, 45 bp, Artificial Sequence
  FX-R93E-For primer
gaggtggtcatcaagcacaacgagttcacaaaggagacctatgac

SEQ ID NO: 350 - DNA, 45 bp, Artificial Sequence
  FX-R93A-For primer
gaggtggtcatcaagcacaacgccttcacaaaggagacctatgac

SEQ ID NO: 351 - DNA, 45 bp, Artificial Sequence
  FX-R240A-For primer
gccttcctcaagtggatcgacgcctccatgaaaaccaggggcttg

SEQ ID NO: 352 - DNA, 45 bp, Artificial Sequence
  FX-R240E-For primer
gccttcctcaagtggatcgacgagtccatgaaaaccaggggcttg

SEQ ID NO: 353 - DNA, 45 bp, Artificial Sequence
  FX-K236A-For primer
accaaggtcaccgccttcctcgcctggatcgacaggtccatgaaa

SEQ ID NO: 354 - DNA, 45 bp, Artificial Sequence
  FX-K236E-For primer
accaaggtcaccgccttcctcgagtggatcgacaggtccatgaaa

SEQ ID NO: 355 - DNA, 45 bp, Artificial Sequence
  FX-R125A-For primer
gcgcctgcctgcctccccgaggccgactgggccgagtccacgctg

SEQ ID NO: 356 - DNA, 45 bp, Artificial Sequence
  FX-R125E-For primer
gcgcctgcctgcctccccgaggaggactgggccgagtccacgctg

SEQ ID NO: 357 - DNA, 45 bp, Artificial Sequence
  FX-K96A-For primer
atcaagcacaaccggttcacagccgagacctatgacttcgacatc

SEQ ID NO: 358 - DNA, 45 bp, Artificial Sequence
  FX-K96E-For primer
atcaagcacaaccggttcacagaggagacctatgacttcgacatc

SEQ ID NO: 359 - DNA, 45 bp, Artificial Sequence
  FX-K236E/R240E-For primer
gtcaccgccttcctcgagtggatcgacgagtccatgaaaaccagg

SEQ ID NO: 360 - DNA, 45 bp, Artificial Sequence
  FX-K156A-For primer
ggccggcagtccaccaggctcgccatgctggaggtgccctacgtg

SEQ ID NO: 361 - DNA, 45 bp, Artificial Sequence
  FX-K156S-For primer
ggccggcagtccaccaggctcagcatgctggaggtgccctacgtg

SEQ ID NO: 362 - DNA, 33 bp, Artificial Sequence
  FX-E[51]N-For primer
gatggcgaccagtgtaacaccagtccttgccag

SEQ ID NO: 363 - DNA, 39 bp, Artificial Sequence
  FX-Q[56]N/Q[58]S-For primer
gagaccagtccttgcaacaacagcggcaaatgtaaagac

SEQ ID NO: 364 - DNA, 40 bp, Artificial Sequence
  FX-Q[58]N/K[60]S-For primer
cagtccttgccagaacaacggcagctgtaaagacggcctc

SEQ ID NO: 365 - DNA, 40 bp, Artificial Sequence
  FX-K[62]N/G[64]S-For primer
gaaccagggcaaatgtaacgacagcctcggggaatacacc

SEQ ID NO: 366 - DNA, 39 bp, Artificial Sequence
  FX-L[65]N/E[67]S-For primer
caaatgtaaagacggcaacgggagctacacctgcacctg

SEQ ID NO: 367 - DNA, 39 bp, Artificial Sequence
  FX-E[67]N-For primer
gtaaagacggcctcgggaactacacctgcacctgtttag

SEQ ID NO: 368 - DNA, 42 bp, Artificial Sequence
  FX-L[73]N/G[75]S-For primer
gaatacacctgcacctgtaacgaaagcttcgaaggcaaaaac

SEQ ID NO: 369 - DNA, 46 bp, Artificial Sequence
  FX-G[75]N/E[77]S-For primer
ctgcacctgtttagaaaacttcagcggcaaaaactgtgaattattc

SEQ ID NO: 370 - DNA, 40 bp, Artificial Sequence
  FX-R[86]N/L[88]S-For primer
ctgtgaattattcacaaacaagagctgcagcctggacaac

SEQ ID NO: 371 - DNA, 43 bp, Artificial Sequence
  FX-T[85]N/K[87]S-For primer
caaaaactgtgaattattcaaccggagcctctgcagcctggac

SEQ ID NO: 372 - DNA, 33 bp, Artificial Sequence
  FX-L[83]N-For primer
ggcaaaaactgtgaaaacttcacacggaagctc

SEQ ID NO: 373 - DNA, 39 bp, Artificial Sequence
  FX-E[82]N/F[84]S-For primer
gaaggcaaaaactgtaacttaagcacacggaagctctgc

SEQ ID NO: 374 - DNA, 33 bp, Artificial Sequence
  FX-E[82]S-For primer
gaaggcaaaaactgtagcttattcacacggaag

SEQ ID NO: 375 - DNA, 42 bp, Artificial Sequence
  FX-G[78]N/N[80]S-For primer
gtttagaaggattcgaaaacaaaagctgtgaattattcacac

SEQ ID NO: 376 - DNA, 40 bp, Artificial Sequence
  FX-E[77]N/K[79]S-For primer
ctgtttagaaggattcaacggcagcaactgtgaattattc

SEQ ID NO: 377 - DNA, 40 bp, Artificial Sequence
  FX-D[95]N/D[97]S-For primer
cagcctggacaacgggaactgtagccagttctgccacgag

SEQ ID NO: 378 - DNA, 34 bp, Artificial Sequence
  FX-G[114]N-For primer
gtgctcctgcgcccgcaactacaccctggctgac

SEQ ID NO: 379 - DNA, 34 bp, Artificial Sequence
  FX-K[122]S-For primer
ctggctgacaacggcagcgcctgcattcccacag

SEQ ID NO: 380 - DNA, 39 bp, Artificial Sequence
  FX-D[119]N/G[121]S-For primer
gggtacaccctggctaacaacagcaaggcctgcattccc

SEQ ID NO: 381 - DNA, 39 bp, Artificial Sequence
  FX-K23N/G25S-For primer
ggaggccaggaatgcaacgacagcgagtgtccctggcag

SEQ ID NO: 382 - DNA, 40 bp, Artificial Sequence
  FX-E36N/N38S-For primer
gccctgctcatcaataacgaaagcgagggtttctgtggtg

SEQ ID NO: 383 - DNA, 39 bp, Artificial Sequence
  FX-R63N/K65S-For primer
ctctaccaagccaagaacttcagcgtgagggtaggggac

SEQ ID NO: 384 - DNA, 39 bp, Artificial Sequence
  FX-E84N/E86S-For primer
ggtgaggcggtgcacaacgtgagcgtggtcatcaagcac

SEQ ID NO: 385 - DNA, 40 bp, Artificial Sequence
  FX-T113N/R115S-For primer
ctcaagacccccatcaacttcagcatgaacgtggcgcctg

SEQ ID NO: 386 - DNA, 39 bp, Artificial Sequence
  FX-K134N/G136S-For primer
acgctgatgacgcagaacacgagcattgtgagcggcttc

SEQ ID NO: 387 - DNA, 39 bp, Artificial Sequence
  FX-R202N/K204S-For primer
ggcccgcacgtcaccaacttcagcgacacctacttcgtg

SEQ ID NO: 388 - DNA, 39 bp, Artificial Sequence
  FX-D205N/Y207S-For primer
gtcacccgcttcaagaacaccagcttcgtgacaggcatc

SEQ ID NO: 389 - DNA, 33 bp, Artificial Sequence
  FX-K204N-For primer
cacgtcacccgcttcaacgacacctacttcgtg

SEQ ID NO: 390 - DNA, 39 bp, Artificial Sequence
  FX-T244N/G246S-For primer
gacaggtccatgaaaaacaggagcttgcccaaggccaag

SEQ ID NO: 391 - DNA, 39 bp, Artificial Sequence
  FX-R245N/L247S-For primer
aggtccatgaaaaccaacggcagccccaaggccaagagc

SEQ ID NO: 392 - DNA, 55 bp, Artificial Sequence
  FX-G[114]N+D[119]N/G[121]S-For primer
gtgctcctgcgcccgcaactacaccctggctaacaacagcaaggcctgcattccc

SEQ ID NO: 393 - protein, 488 aa, Nomascus leucogenys
  Factor X
  ref <308>: DATABASE ACCESSION NUMBER: UniProtKB: G1QI58
  ref <309>: DATABASE ENTRY DATE: 2011-10-19
MGHLLHLVLLSASLAGLLLPGESLFIRREQANNILARVTRANSFLEEMKKGNLERECMEETCSYEEAREVFEDSDKTNEFWNKYKDGDQCETSPCQNEGKCKDGLGEYTCTCLEGFEGKNCELFTRKLCSLDNGDCDQFCHEEQNSVVCSCARGYTLADNGKACIPTGPYPCGKQTLERRKRSVAQATNSSGEGPDSITWKPYDAADLDPTENPFDLLDFNQTQPETGDNNLVRIVGGRECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYHARQEDACQGDSGGPHVTRFKDTYFVTGIVSWGEGCARKGKYGIYTKVTAFLKWIDRSMKTRGLPKAESHAPEVITPSPLK

SEQ ID NO: 394 - protein, 488 aa, Papio anubis
  Factor X
  ref <308>: DATABASE ACCESSION NUMBER: GenBank: ABY40835.1
  ref <309>: DATABASE ENTRY DATE: 2008-02-05
MGRPLHLVLLSAFLASLLLPGESLFIRREQANNVLARVRRSNSFLEELKKGNLERECMEETCSYEEAREVFEDIDKTNEFWNKYKDGDQCETSPCQNEGKCRDGLGEYTCTCLEGFEGKNCELFTRKLCSLDNGDCDQFCHEEQNSVVCSCARGYTLADNGKACIPTGPYPCGKQTLERRKRSAAQATNSSGEASDSIIWKPDDAADLDATENPFDLLDFNQTQPERGDNNLIRIVGGRECENGECPWQALLINEENEGFCGGTILSEFYILTAAHCLYQAKRFKVRVGDRDMEQEEGGEAVHEVEVIIKHNRFTKETYDFDIAVLRLKSPITFRMNVAPACLPERDWAESTLMTQKTGIVSGFGRTHEKGRQSTRLKMLEVPYVDRNSCKLSSSFIITQNMFCAGYHAKQEDACQGDSGGPHVTRFKDTYFVTGIVSWGEGCARKGKYGIYTKVTAFLKWIDRSMKTRGLPKAESRAPEVSTSSPLK

SEQ ID NO: 395 - protein, 488 aa, Macaca mulatta
  Factor X
  ref <308>: DATABASE ACCESSION NUMBER: GenBank: ABK54294.1
  ref <309>: DATABASE ENTRY DATE: 2006-11-14
MGRPLHLVLLSAFLASLLLPGESLFIRREQANNVLARVRRSNSFLEEMKKGNLERECMEETCSYEEAREVLEDSDKTNEFWNKYKDGDQCETSPCQNEGKCRDGLGEYTCTCLEGFEGKNCELFTRKLCSLDNGECDQFCHEEQNSVVCSCARGYTLADNGKACIPTGPYPCGKQTLERRKRSAAQATNSSGEAPDNIIWKPDDAADLDATENPFDLLDFNQTQPERGDNNLIRIVGGRECENGECPWQALLINEENEGFCGGTILSEFYILTAAHCLYQAKRFKVRVGDRDMEQEEGGEAVHEVEVIIKHNRFTKETYDFDIAVLRLKSPITFRMNVAPACLPERDWAESTLMTQKTGIVSGFGRTHEKGRQSTRLKMLEVPYVDRNSCKLSSSFIITQNMFCAGYHAKQEDACQGDSGGPHVTRFKDTYFVTGIVSWGEGCARKGKYGIYTKVTAFLKWIDRSMKTRGLPKAESRAPEASTSSPLK

SEQ ID NO: 396 - protein, 488 aa, Callicebus moloch
  Factor X
  ref <308>: DATABASE ACCESSION NUMBER: UniProtKB: B1MTD3
  ref <309>: DATABASE ENTRY DATE: 2008-04-29
MGHPLHLVLLSASLAGLLLPGGSLFIRREQANNVLARVRRANSILEELKKGNLERECMEETCSYEEAREVFEDSDQTNEFWNKYKDGDQCESDPCQNQGKCKDGLGQYTCTCLEGFEGKNCELFTRKLCSLDNGDCDQFCHEEQNSVVCSCASGYVLADDGKACIPTGPYPCGKLTLERRKRAAAQATHRRGETPGTITRPQHNTSDPDPTENPFDLLGFNQTQPEWEESDLVRIVGGRDCKDGECPWQALLINEENEGFCGGTILSEFHVLTAAHCLHQAKRFKVRVGDRNTEKEEGGETVHEVEVIIKHNRFSIETYDFDITVLRLKTPITFRMNVAPACLPARDWAESTLMTQKTGIVSGFGRTHEKGRQSTTLKILEVPYVDRNTCKLSSSFTITQNMFCAGYEARQEDACQGDSGGPHVTRFKDTYFVTGIVSWGEGCARKGKYGIYTKVSGFLKWIDRSMKTRGVPKAESHVPGVNTSSPLK

SEQ ID NO: 397 - protein, 477 aa, Loxodonta africana
  Factor X
  ref <308>: DATABASE ACCESSION NUMBER: UniProtKB: G3TXA1
  ref <309>: DATABASE ENTRY DATE: 2011-11-16
MASWPCLVLLSASLAGLLLPGASVFINREHASNVLQRARRANSFLEEMKQGNLERECMEETCSFEEAREVFEDDVKTNEFWNRYKDGDQCESNPCQNQGKCQDGLGEYTCTCLEGFEGKNCELTIRELCSLDNGDCDQFCNEERNSVVCSCAAGYTLGDNGKSCISTEPFPCGKLTMGRNKRSLAQANNVSGSPPETSTQKQYGLDDLAPTENPVNLLNLNQEFPEQDTSDLVRIVGGRDCKEGECPWQALLVNEENEGFCGGTILNEYYILTAAHCLHQAKRFKVRVGDRNTEKEEGNEMAHEVEIILKHNKFVRETYDFDIAVIKLKTPITFRMNVAPACLPEKDWAESTLMTQKTGIVSGFGRTHEKGRASTILKMLEVPYVDRNTCKLSSSFTITQNMFCAGYDSKPEDACQGDSGGPHVTRFKDTYFVTGIVSWGEGCARKGKYGVYTKVTSFLKWIDRCMKTKAGVHAQAP

SEQ ID NO: 398 - protein, 481 aa, Mus musculus
  Factor X
  ref <308>: DATABASE ACCESSION NUMBER: UniProtKB: O88947
  ref <309>: DATABASE ENTRY DATE: 1998-11-01
MGSPVQLSLLCVVLASLLLPGKGVFINRERANNVLARTRRANSFFEEFKKGNLERECMEEICSYEEVREIFEDDEKTKEYWTKYKDGDQCESSPCQNQGACRDGIGGYTCTCSEGFEGKNCELFVRKLCRLDNGDCDQFCREEQNSVVCSCASGYFLGNDGKSCISTAPFPCGKITTGRRKRSVALNTSDSELDLEDALLDEDFLSPTENPIELLNLNETQPERSSDDLVRIVGGRECKDGECPWQALLINEDNEGFCGGTILNEFYILTAAHCLHQARRFKVRVGDRNTEKEEGNEMVHEVDVVIKHNKFQRDTYDYDIAVLRLKTPITFRMNVAPACLPQKDWAESTLMTQKTGIVSGFGRTHEKGRQSNILKMLEVPYVDRNTCKLSTSFSITQNMFCAGYEAKLEDACQGDSGGPHVTRFKNTYYVTGIVSWGEGCARKGKYGIYTKVTTFLKWIDRSMKARVGPTAETPRTAGPPN

SEQ ID NO: 399 - protein, 490 aa, Oryctolagus cuniculus
  Factor X
  ref <308>: DATABASE ACCESSION NUMBER: UniProtKB: O19045
  ref <309>: DATABASE ENTRY DATE: 1998-01-01
MANPLHLVLLGAALAGLLLSGSSVFISRRAANDVLARTRRANSFLEELKKGNLERECMEENCSYEEALEVFEDREKTNEFWNKYVDGDQCESNPCQNQGTCKDGLGMYTCSCVEGYEGQDCEPVTRKLCSLDNGGCDQFCKEEENSVLCSCASGYTLGDNGKSCISTELFPCGKVTLGRWRRSPATNSSEGPPEAPGPEQQDDGNLTATENPFNLLDSPEPPPEDDSSSLVRIVGGQDCRDGECPWQALLVNEENEGFCGGTILSEYHVLTAAHCLHQAKRFKVRVGDRDTEHEEGNEETHEVEVVVKHNRFVKETYDFDIAVLRLKTPITFRRNVAPACLPQKDWAESTLMAQKTGIVSGFGRTHEMGRLSTTLKMLEVPYVDRNSCKRSSSFTITQNMFCAGYDARPEDACQGDSGGPHVTRFRDTYFVTGIVSWGEGCARKGKFGVYTKVSNFLKWIEKSMRARAVPVAEAAGTPGPTQPTIKGSPS

SEQ ID NO: 400 - protein, 482 aa, Rattus norvegicus
  Factor X
  ref <308>: DATABASE ACCESSION NUMBER: UniProtKB: Q63207
  ref <309>: DATABASE ENTRY DATE: 1996-11-01
MESPVRLSLLYVVLASLLLPGRSVFINRERANNVLQRIRRANSFFEEIKKGNLERECVEEICSFEEAREVFEDNEKTTEFWNKYEDGDQCESSPCQNQGECRDGLGSYTCTCTEGFEGKNCELFVRKLCSLDNGDCDQFCREEQNSVVCSCAKGYFLGNDGKSCLSTAPFPCGKTNKGRAKRSVALNTSNSEPDPEDLMPDADILYPTESPSELLNLNKTEPEANSDDVIRIVGGQECKRGECPWQALLFSDEETDGFCGGTILNEFYILTAAHCLHQAKRFKVRVGDLNTEQEDGGEMVHEVDMIIKHNKFQRDTYDFDIAMLRLKTPITFRENVAPACLPQKDWAEATLMTQKTGIVSGFGRTHEKGRQSKVLKMMEVPYVDRNTCRLSTSFSITQNMFCAGYDAKQEDACQGDSGGPHVTRFKDTYFVTGIVSWGEGCARKGKYGIYTKVTAFLKWIDRSMKARVGPTSETPRLTHPPY

SEQ ID NO: 401 - protein, 499 aa, Canis familiaris
  Factor X
  ref <308>: DATABASE ACCESSION NUMBER: UniProtKB: F1Q4A3
  ref <309>: DATABASE ENTRY DATE: 2011-05-03
MAGPLCLVLLSASLACLPLPGGSVFLSPERASSVLGRVRRANSFLEEMKKGNLERECMEETCSFEEAREVFEDTAKTMEFWNKYKDGDQCESSPCQNQGQCKDGLLEYSCICLEGYEGKNCELSTRKLCSVDNGDCDQFCREEQSSVVCSCASGYILGDNGKSCISTEPFPCGKTTVGRRKRATETAPSSEAPPDAEEEAGMLEQYDPGDLSPTQSTMFLLPFNQTNSDPDEDASGLVRIVGGQDCRDGECPWQALLINEENEGFCGGTILSEYYILTAAHCLQQAKKFTVRVGERDTDKEEGNEVAHEVEMIIKHNKFVRETYDFDIAVIKLKTPITFRMNVAPACLPQKDWAESTLMTQKTGIVSGFGKTHEKGRPSTTLKMMEVPYVDRNTCKLSSSFSITQNMFCAGYDSKPEDACQGDSGGPHVTRFKDTYFVTGIVSWGEGCARKGKYGIYTKVTNFLKWIDRSMKARAGWGGFFGKKERPPSLWADPPPGPC

SEQ ID NO: 402 - protein, 479 aa, Sus scrofa
  Factor X
  ref <308>: DATABASE ACCESSION NUMBER: UniProtKB: F1RN41
  ref <309>: DATABASE ENTRY DATE: 2011-05-03
MVGLPSLVLLSASLAGLLLPGGSVFLPRDRAHSVLERARRANSFWEEMKKGNLERECLEETCSYEEAREVFEDQQKTDEFWNKYKDGDQCESSPCQNQGKCKDGLGEYNCTCAEGFEGKNCELLTRKLCSLDNGDCDQFCREEQSSVVCSCASGYILGDNGKSCISTEPFPCGKRTLGRSRRSADHGSEAAPEAGRSEQEPRDLGPTEGPLHLLSLNDTEPGPEEDEDESSLVRIVGGRDCREGECPWQALLVNEENEGFCGGTILSEFHVLTAAHCLHQAKKFKVRVGDRNLEKEEGDEAAHEVEVTVKHSRFVRETYDFDIAVLKLKTPITFRTNVAPACLPEKNWAEATLLTQKTGIVSGFGRTHERGRPSSTLKMLEVPYVDRNTCKLSSSFLITPNMFCAGYDEQPEDACQGDSGGPHVTRFRDTYFVTGIVSWGEGCARRGKYGVYTKVTNFLKWIERSMRARAEAGAEPHPQ

SEQ ID NO: 403 - protein, 492 aa, Bos taurus
  Factor X
  ref <308>: DATABASE ACCESSION NUMBER: UniProtKB: P00743
  ref <309>: DATABASE ENTRY DATE: 1987-08-13
MAGLLHLVLLSTALGGLLRPAGSVFLPRDQAHRVLQRARRANSFLEEVKQGNLERECLEEACSLEEAREVFEDAEQTDEFWSKYKDGDQCEGHPCLNQGHCKDGIGDYTCTCAEGFEGKNCEFSTREICSLDNGGCDQFCREERSEVRCSCAHGYVLGDDSKSCVSTERFPCGKFTQGRSRRWAIHTSEDALDASELEHYDPADLSPTESSLDLLGLNRTEPSAGEDGSQVVRIVGGRDCAEGECPWQALLVNEENEGFCGGTILNEFYVLTAAHCLHQAKRFTVRVGDRNTEQEEGNEMAHEVEMTVKHSRFVKETYDFDIAVLRLKTPIRFRRNVAPACLPEKDWAEATLMTQKTGIVSGFGRTHEKGRLSSTLKMLEVPYVDRSTCKLSSSFTITPNMFCAGYDTQPEDACQGDSGGPHVTRFKDTYFVTGIVSWGEGCARKGKFGVYTKVSNFLKWIDKIMKARAGAAGSRGHSEAPATWTVPPPLPL

SEQ ID NO: 404 - protein, 448 aa, Nomascus leucogenys
  mature Factor X protein
ANSFLEEMKKGNLERECMEETCSYEEAREVFEDSDKTNEFWNKYKDGDQCETSPCQNEGKCKDGLGEYTCTCLEGFEGKNCELFTRKLCSLDNGDCDQFCHEEQNSVVCSCARGYTLADNGKACIPTGPYPCGKQTLERRKRSVAQATNSSGEGPDSITWKPYDAADLDPTENPFDLLDFNQTQPETGDNNLVRIVGGRECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYHARQEDACQGDSGGPHVTRFKDTYFVTGIVSWGEGCARKGKYGIYTKVTAFLKWIDRSMKTRGLPKAESHAPEVITPSPLK

SEQ ID NO: 405 - protein, 448 aa, Papio anubis
  mature Factor X protein
SNSFLEELKKGNLERECMEETCSYEEAREVFEDIDKTNEFWNKYKDGDQCETSPCQNEGKCRDGLGEYTCTCLEGFEGKNCELFTRKLCSLDNGDCDQFCHEEQNSVVCSCARGYTLADNGKACIPTGPYPCGKQTLERRKRSAAQATNSSGEASDSIIWKPDDAADLDATENPFDLLDFNQTQPERGDNNLIRIVGGRECENGECPWQALLINEENEGFCGGTILSEFYILTAAHCLYQAKRFKVRVGDRDMEQEEGGEAVHEVEVIIKHNRFTKETYDFDIAVLRLKSPITFRMNVAPACLPERDWAESTLMTQKTGIVSGFGRTHEKGRQSTRLKMLEVPYVDRNSCKLSSSFIITQNMFCAGYHAKQEDACQGDSGGPHVTRFKDTYFVTGIVSWGEGCARKGKYGIYTKVTAFLKWIDRSMKTRGLPKAESRAPEVSTSSPLK

SEQ ID NO: 406 - protein, 448 aa, Macaca mulatta
  mature Factor X protein
SNSFLEEMKKGNLERECMEETCSYEEAREVLEDSDKTNEFWNKYKDGDQCETSPCQNEGKCRDGLGEYTCTCLEGFEGKNCELFTRKLCSLDNGECDQFCHEEQNSVVCSCARGYTLADNGKACIPTGPYPCGKQTLERRKRSAAQATNSSGEAPDNIIWKPDDAADLDATENPFDLLDFNQTQPERGDNNLIRIVGGRECENGECPWQALLINEENEGFCGGTILSEFYILTAAHCLYQAKRFKVRVGDRDMEQEEGGEAVHEVEVIIKHNRFTKETYDFDIAVLRLKSPITFRMNVAPACLPERDWAESTLMTQKTGIVSGFGRTHEKGRQSTRLKMLEVPYVDRNSCKLSSSFIITQNMFCAGYHAKQEDACQGDSGGPHVTRFKDTYFVTGIVSWGEGCARKGKYGIYTKVTAFLKWIDRSMKTRGLPKAESRAPEASTSSPLK

SEQ ID NO: 407 - protein, 448 aa, Callicebus moloch
  mature Factor X protein
ANSILEELKKGNLERECMEETCSYEEAREVFEDSDQTNEFWNKYKDGDQCESDPCQNQGKCKDGLGQYTCTCLEGFEGKNCELFTRKLCSLDNGDCDQFCHEEQNSVVCSCASGYVLADDGKACIPTGPYPCGKLTLERRKRAAAQATHRRGETPGTITRPQHNTSDPDPTENPFDLLGFNQTQPEWEESDLVRIVGGRDCKDGECPWQALLINEENEGFCGGTILSEFHVLTAAHCLHQAKRFKVRVGDRNTEKEEGGETVHEVEVIIKHNRFSIETYDFDITVLRLKTPITFRMNVAPACLPARDWAESTLMTQKTGIVSGFGRTHEKGRQSTTLKILEVPYVDRNTCKLSSSFTITQNMFCAGYEARQEDACQGDSGGPHVTRFKDTYFVTGIVSWGEGCARKGKYGIYTKVSGFLKWIDRSMKTRGVPKAESHVPGVNTSSPLK

SEQ ID NO: 408 - protein, 437 aa, Loxodonta africana
  mature Factor X protein
ANSFLEEMKQGNLERECMEETCSFEEAREVFEDDVKTNEFWNRYKDGDQCESNPCQNQGKCQDGLGEYTCTCLEGFEGKNCELTIRELCSLDNGDCDQFCNEERNSVVCSCAAGYTLGDNGKSCISTEPFPCGKLTMGRNKRSLAQANNVSGSPPETSTQKQYGLDDLAPTENPVNLLNLNQEFPEQDTSDLVRIVGGRDCKEGECPWQALLVNEENEGFCGGTILNEYYILTAAHCLHQAKRFKVRVGDRNTEKEEGNEMAHEVEIILKHNKFVRETYDFDIAVIKLKTPITFRMNVAPACLPEKDWAESTLMTQKTGIVSGFGRTHEKGRASTILKMLEVPYVDRNTCKLSSSFTITQNMFCAGYDSKPEDACQGDSGGPHVTRFKDTYFVTGIVSWGEGCARKGKYGVYTKVTSFLKWIDRCMKTKAGVHAQAP

SEQ ID NO: 409 - protein, 441 aa, Mus musculus
  mature Factor X protein
ANSFFEEFKKGNLERECMEEICSYEEVREIFEDDEKTKEYWTKYKDGDQCESSPCQNQGACRDGIGGYTCTCSEGFEGKNCELFVRKLCRLDNGDCDQFCREEQNSVVCSCASGYFLGNDGKSCISTAPFPCGKITTGRRKRSVALNTSDSELDLEDALLDEDFLSPTENPIELLNLNETQPERSSDDLVRIVGGRECKDGECPWQALLINEDNEGFCGGTILNEFYILTAAHCLHQARRFKVRVGDRNTEKEEGNEMVHEVDVVIKHNKFQRDTYDYDIAVLRLKTPITFRMNVAPACLPQKDWAESTLMTQKTGIVSGFGRTHEKGRQSNILKMLEVPYVDRNTCKLSTSFSITQNMFCAGYEAKLEDACQGDSGGPHVTRFKNTYYVTGIVSWGEGCARKGKYGIYTKVTTFLKWIDRSMKARVGPTAETPRTAGPPN

SEQ ID NO: 410 - protein, 450 aa, Oryctolagus cuniculus
  mature Factor X protein
ANSFLEELKKGNLERECMEENCSYEEALEVFEDREKTNEFWNKYVDGDQCESNPCQNQGTCKDGLGMYTCSCVEGYEGQDCEPVTRKLCSLDNGGCDQFCKEEENSVLCSCASGYTLGDNGKSCISTELFPCGKVTLGRWRRSPATNSSEGPPEAPGPEQQDDGNLTATENPFNLLDSPEPPPEDDSSSLVRIVGGQDCRDGECPWQALLVNEENEGFCGGTILSEYHVLTAAHCLHQAKRFKVRVGDRDTEHEEGNEETHEVEVVVKHNRFVKETYDFDIAVLRLKTPITFRRNVAPACLPQKDWAESTLMAQKTGIVSGFGRTHEMGRLSTTLKMLEVPYVDRNSCKRSSSFTITQNMFCAGYDARPEDACQGDSGGPHVTRFRDTYFVTGIVSWGEGCARKGKFGVYTKVSNFLKWIEKSMRARAVPVAEAAGTPGPTQPTIKGSPS

SEQ ID NO: 411 - protein, 442 aa, Rattus norvegicus
  mature Factor X protein
ANSFFEEIKKGNLERECVEEICSFEEAREVFEDNEKTTEFWNKYEDGDQCESSPCQNQGECRDGLGSYTCTCTEGFEGKNCELFVRKLCSLDNGDCDQFCREEQNSVVCSCAKGYFLGNDGKSCLSTAPFPCGKTNKGRAKRSVALNTSNSEPDPEDLMPDADILYPTESPSELLNLNKTEPEANSDDVIRIVGGQECKRGECPWQALLFSDEETDGFCGGTILNEFYILTAAHCLHQAKRFKVRVGDLNTEQEDGGEMVHEVDMIIKHNKFQRDTYDFDIAMLRLKTPITFRENVAPACLPQKDWAEATLMTQKTGIVSGFGRTHEKGRQSKVLKMMEVPYVDRNTCRLSTSFSITQNMFCAGYDAKQEDACQGDSGGPHVTRFKDTYFVTGIVSWGEGCARKGKYGIYTKVTAFLKWIDRSMKARVGPTSETPRLTHPPY

SEQ ID NO: 412 - protein, 459 aa, Canis familiaris
  mature Factor X protein
ANSFLEEMKKGNLERECMEETCSFEEAREVFEDTAKTMEFWNKYKDGDQCESSPCQNQGQCKDGLLEYSCICLEGYEGKNCELSTRKLCSVDNGDCDQFCREEQSSVVCSCASGYILGDNGKSCISTEPFPCGKTTVGRRKRATETAPSSEAPPDAEEEAGMLEQYDPGDLSPTQSTMFLLPFNQTNSDPDEDASGLVRIVGGQDCRDGECPWQALLINEENEGFCGGTILSEYYILTAAHCLQQAKKFTVRVGERDTDKEEGNEVAHEVEMIIKHNKFVRETYDFDIAVIKLKTPITFRMNVAPACLPQKDWAESTLMTQKTGIVSGFGKTHEKGRPSTTLKMMEVPYVDRNTCKLSSSFSITQNMFCAGYDSKPEDACQGDSGGPHVTRFKDTYFVTGIVSWGEGCARKGKYGIYTKVTNFLKWIDRSMKARAGWGGFFGKKERPPSLWADPPPGPC

SEQ ID NO: 413 - protein, 439 aa, Sus scrofa
  mature Factor X protein
ANSFWEEMKKGNLERECLEETCSYEEAREVFEDQQKTDEFWNKYKDGDQCESSPCQNQGKCKDGLGEYNCTCAEGFEGKNCELLTRKLCSLDNGDCDQFCREEQSSVVCSCASGYILGDNGKSCISTEPFPCGKRTLGRSRRSADHGSEAAPEAGRSEQEPRDLGPTEGPLHLLSLNDTEPGPEEDEDESSLVRIVGGRDCREGECPWQALLVNEENEGFCGGTILSEFHVLTAAHCLHQAKKFKVRVGDRNLEKEEGDEAAHEVEVTVKHSRFVRETYDFDIAVLKLKTPITFRTNVAPACLPEKNWAEATLLTQKTGIVSGFGRTHERGRPSSTLKMLEVPYVDRNTCKLSSSFLITPNMFCAGYDEQPEDACQGDSGGPHVTRFRDTYFVTGIVSWGEGCARRGKYGVYTKVTNFLKWIERSMRARAEAGAEPHPQ

SEQ ID NO: 414 - protein, 452 aa, Bos taurus
  mature Factor X protein
ANSFLEEVKQGNLERECLEEACSLEEAREVFEDAEQTDEFWSKYKDGDQCEGHPCLNQGHCKDGIGDYTCTCAEGFEGKNCEFSTREICSLDNGGCDQFCREERSEVRCSCAHGYVLGDDSKSCVSTERFPCGKFTQGRSRRWAIHTSEDALDASELEHYDPADLSPTESSLDLLGLNRTEPSAGEDGSQVVRIVGGRDCAEGECPWQALLVNEENEGFCGGTILNEFYVLTAAHCLHQAKRFTVRVGDRNTEQEEGNEMAHEVEMTVKHSRFVKETYDFDIAVLRLKTPIRFRRNVAPACLPEKDWAEATLMTQKTGIVSGFGRTHEKGRLSSTLKMLEVPYVDRSTCKLSSSFTITPNMFCAGYDTQPEDACQGDSGGPHVTRFKDTYFVTGIVSWGEGCARKGKFGVYTKVSNFLKWIDKIMKARAGAAGSRGHSEAPATWTVPPPLPL

SEQ ID NO: 415 - protein, 491 aa, Artificial Sequence
  Human Factor X with thrombin signal and propeptide sequences (Thrombin-Factor X fusion polypeptide)
  PROPEP (1)...(43): Thrombin signal peptide and propeptide
  PEPTIDE (44)...(491): Mature Factor X peptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 416 - protein, 491 aa, Artificial Sequence
  Thombin-Factor X I195L fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 417 - protein, 491 aa, Artificial Sequence
  Thombin-Factor X V196I fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIIGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 418 - protein, 491 aa, Artificial Sequence
  Thombin-Factor X V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 419 - protein, 491 aa, Artificial Sequence
  Thombin-Factor X T85N/K87S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFNRSLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 420 - protein, 491 aa, Artificial Sequence
  Thombin-Factor X Q56N/Q58S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCNNSGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 421 - protein, 491 aa, Artificial Sequence
  Thombin-Factor X K62N/G64S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCNDSLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 422 - protein, 491 aa, Artificial Sequence
  Thombin-Factor X L65N/E67S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGNGSYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 423 - protein, 491 aa, Artificial Sequence
  Thombin-Factor X E67N/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGNYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 424 - protein, 491 aa, Artificial Sequence
  Thombin-Factor X L73N/G75S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCNESFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 425 - protein, 491 aa, Artificial Sequence
  Thombin-Factor X G75N/E77S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLENFSGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 426 - protein, 491 aa, Artificial Sequence
  Thombin-Factor X R86N/L88S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTNKSCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 427 - protein, 491 aa, Artificial Sequence
  Thombin-Factor X G114N/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 428 - protein, 491 aa, Artificial Sequence
  Thombin-Factor X D95N/D97S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGNCSQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 429 - protein, 491 aa, Artificial Sequence
  Thombin-Factor X E82S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCSLFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 430 - protein, 491 aa, Artificial Sequence
  Thombin-Factor X E82N/F84S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCNLSTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 431 - protein, 491 aa, Artificial Sequence
  Thombin-Factor X G78N/N80S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFENKSCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 432 - protein, 491 aa, Artificial Sequence
  Thombin-Factor X E77N/K79S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFNGSNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 433 - protein, 491 aa, Artificial Sequence
  Thombin-Factor X D119N/G121S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 434 - protein, 491 aa, Artificial Sequence
  Thombin-Factor X L83N/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCENFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 435 - protein, 491 aa, Artificial Sequence
  Thombin-Factor X K122S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGSACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 436 - protein, 491 aa, Artificial Sequence
  Thombin-Factor X E51N/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCNTSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 437 - protein, 491 aa, Artificial Sequence
  Thombin-Factor X Q58N/K60S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNNGSCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 438 - protein, 491 aa, Artificial Sequence
  Thombin-Factor X G114N/D119N/G121S/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 439 - protein, 491 aa, Artificial Sequence
  Thombin-Factor X G198A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGAQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 440 - protein, 491 aa, Artificial Sequence
  Thombin-Factor X G198V fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGVQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 441 - protein, 491 aa, Artificial Sequence
  Thombin-Factor X G198R fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGRQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 442 - protein, 491 aa, Artificial Sequence
  Thombin-Factor X G198K fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGKQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 443 - protein, 491 aa, Artificial Sequence
  Thombin-Factor X G198P fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGPQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 444 - protein, 491 aa, Artificial Sequence
  Thombin-Factor X G198H fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGHQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 445 - protein, 491 aa, Artificial Sequence
  Thombin-Factor X L211S/G219H fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 446 - protein, 491 aa, Artificial Sequence
  Thombin-Factor X G197P fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVPGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 447 - protein, 491 aa, Artificial Sequence
  Thombin-Factor X D378N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGNSGGPHVTRFKDTYFVTGIVSWGEGCARKGKYGIYTKVTAFLKWIDRSMKTRGLPKAKSHAPEVITSSPLK

SEQ ID NO: 448 - protein, 491 aa, Artificial Sequence
  Thombin-Factor X D378S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGSSGGPHVTRFKDTYFVTGIVSWGEGCARKGKYGIYTKVTAFLKWIDRSMKTRGLPKAKSHAPEVITSSPLK

SEQ ID NO: 449 - protein, 491 aa, Artificial Sequence
  Thombin-Factor X V196L fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRILGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 450 - protein, 491 aa, Artificial Sequence
  Thombin-Factor X V196T fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRITGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 451 - protein, 491 aa, Artificial Sequence
  Thombin-Factor X V196P fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIPGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 452 - protein, 491 aa, Artificial Sequence
  Thombin-Factor X G197V fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVVGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 453 - protein, 491 aa, Artificial Sequence
  Thombin-Factor X G197T fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVTGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 454 - protein, 491 aa, Artificial Sequence
  Thombin-Factor X G197S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVSGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 455 - protein, 491 aa, Artificial Sequence
  Thombin-Factor X E200A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQACKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 456 - protein, 491 aa, Artificial Sequence
  Thombin-Factor X E200S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQSCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 457 - protein, 491 aa, Artificial Sequence
  Thombin-Factor X E200V fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQVCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 458 - protein, 491 aa, Artificial Sequence
  Thombin-Factor X K202S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECSDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 459 - protein, 491 aa, Artificial Sequence
  Thombin-Factor X R326A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGATHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 460 - protein, 491 aa, Artificial Sequence
  Thombin-Factor X R326S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGSTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 461 - protein, 491 aa, Artificial Sequence
  Thombin-Factor X R326T fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGTTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 462 - protein, 491 aa, Artificial Sequence
  Thombin-Factor X R326V fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGVTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 463 - protein, 491 aa, Artificial Sequence
  Thombin-Factor X R326Q fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGQTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 464 - protein, 491 aa, Artificial Sequence
  Thombin-Factor X R326N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGNTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 465 - protein, 491 aa, Artificial Sequence
  Thombin-Factor X R326M fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGMTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 466 - protein, 491 aa, Artificial Sequence
  Thombin-Factor X R326K fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGKTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 467 - protein, 491 aa, Artificial Sequence
  Thombin-Factor X R326Y fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGYTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 468 - protein, 491 aa, Artificial Sequence
  Thombin-Factor X T327A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLALKTPITFRMNVAPACLPERDWAESTLMTQKTGIVSGFGRAHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 469 - protein, 491 aa, Artificial Sequence
  Thombin-Factor X T327L fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 470 - protein, 491 aa, Artificial Sequence
  Thombin-Factor X S334A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQATRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 471 - protein, 491 aa, Artificial Sequence
  Thombin-Factor X S334T fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQTTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 472 - protein, 491 aa, Artificial Sequence
  Thombin-Factor X S334N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQNTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 473 - protein, 491 aa, Artificial Sequence
  Thombin-Factor X R336E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTELKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 474 - protein, 491 aa, Artificial Sequence
  Thombin-Factor X K338A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLAMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 475 - protein, 491 aa, Artificial Sequence
  Thombin-Factor X K338S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLSMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 476 - protein, 491 aa, Artificial Sequence
  Thombin-Factor X K338N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLNMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 477 - protein, 491 aa, Artificial Sequence
  Thombin-Factor X K338R fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLRMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 478 - protein, 491 aa, Artificial Sequence
  Thombin-Factor X K338V fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLVMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 479 - protein, 491 aa, Artificial Sequence
  Thombin-Factor X K338Y fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLYMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 480 - protein, 491 aa, Artificial Sequence
  Thombin-Factor X K338M fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 481 - protein, 491 aa, Artificial Sequence
  Thombin-Factor X T327A/K338A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRAHEKGRQSTRLAMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 482 - protein, 491 aa, Artificial Sequence
  Thombin-Factor X T327L/K338M fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQSTRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 483 - protein, 491 aa, Artificial Sequence
  Thombin-Factor X E200V/T327L/K338M fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQVCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQSTRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 484 - protein, 491 aa, Artificial Sequence
  Thombin-Factor X E200V/T327L/S334A/K338M fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQVCKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRLHEKGRQATRLMMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 485 - protein, 491 aa, Artificial Sequence
  Thombin-Factor X V196S/G197A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISAGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 486 - protein, 491 aa, Artificial Sequence
  Thombin-Factor X V196S/L211S/G219H fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 487 - protein, 491 aa, Artificial Sequence
  Thombin-Factor X D119N/G121S/V196S/L211S/G219H fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 488 - protein, 491 aa, Artificial Sequence
  Thombin-Factor X G114N/V196S/L211S/G219H fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 489 - protein, 491 aa, Artificial Sequence
  Thombin-Factor X G114N/D119N/G121S/V196S/L211S/G219H fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 490 - protein, 491 aa, Artificial Sequence
  Thombin-Factor X G197A/L211S/G219H fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVAGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 491 - protein, 491 aa, Artificial Sequence
  Thombin-Factor X V196S/G197A/L211S/G219H fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISAGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 492 - protein, 491 aa, Artificial Sequence
  Thombin-Factor X I195L/V196S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLSGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 493 - protein, 491 aa, Artificial Sequence
  Thombin-Factor X I195L/G197A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLVAGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 494 - protein, 491 aa, Artificial Sequence
  Thombin-Factor X I195L/L211S/G219H fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRLVGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 495 - protein, 491 aa, Artificial Sequence
  Thombin-Factor X V196S/N214D fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLIDEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 496 - protein, 491 aa, Artificial Sequence
  Thombin-Factor X V196S/N214A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLIAEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 497 - protein, 491 aa, Artificial Sequence
  Thombin-Factor X V196S/N214S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLISEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 498 - protein, 491 aa, Artificial Sequence
  Thombin-Factor X V196S/E216R fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINERNEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 499 - protein, 491 aa, Artificial Sequence
  Thombin-Factor X V196S/E216K fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEKNEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 500 - protein, 491 aa, Artificial Sequence
  Thombin-Factor X V196S/E216A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEANEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 501 - protein, 491 aa, Artificial Sequence
  Thombin-Factor X V196S/E216S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINESNEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 502 - protein, 491 aa, Artificial Sequence
  Thombin-Factor X V196S/E218R fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENRGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 503 - protein, 491 aa, Artificial Sequence
  Thombin-Factor X V196S/E218K fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENKGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 504 - protein, 491 aa, Artificial Sequence
  Thombin-Factor X V196S/E218A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENAGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 505 - protein, 491 aa, Artificial Sequence
  Thombin-Factor X V196S/R332A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGAQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 506 - protein, 491 aa, Artificial Sequence
  Thombin-Factor X V196S/R332D fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGDQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 507 - protein, 491 aa, Artificial Sequence
  Thombin-Factor X V196S/R332E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGEQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 508 - protein, 491 aa, Artificial Sequence
  Thombin-Factor X V196S/R332S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGSQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 509 - protein, 491 aa, Artificial Sequence
  Thombin-Factor X V196S/R332G fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGGQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 510 - protein, 491 aa, Artificial Sequence
  Thombin-Factor X V196S/R326E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGETHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 511 - protein, 491 aa, Artificial Sequence
  Thombin-Factor X V196S/R326D fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGDTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 512 - protein, 491 aa, Artificial Sequence
  Thombin-Factor X V196S/R326M fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGMTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 513 - protein, 491 aa, Artificial Sequence
  Thombin-Factor X V196S/R326N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGNTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 514 - protein, 491 aa, Artificial Sequence
  Thombin-Factor X V196S/R326Q fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGQTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 515 - protein, 491 aa, Artificial Sequence
  Thombin-Factor X V196S/R273E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNEFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 516 - protein, 491 aa, Artificial Sequence
  Thombin-Factor X V196S/R273A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNAFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 517 - protein, 491 aa, Artificial Sequence
  Thombin-Factor X V196S/R424A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDASMKTRGLPKAKSHAPEVITSSPLK

SEQ ID NO: 518 - protein, 491 aa, Artificial Sequence
  Thombin-Factor X V196S/R424E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDESMKTRGLPKAKSHAPEVITSSPLK

SEQ ID NO: 519 - protein, 491 aa, Artificial Sequence
  Thombin-Factor X V196S/K420A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLAWIDRSMKTRGLPKAKSHAPEVITSSPLK

SEQ ID NO: 520 - protein, 491 aa, Artificial Sequence
  Thombin-Factor X V196S/K420E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSEGPHVTRFKDTYFVTGIVSWGEGCARKGKYGIYTKVTAFLEWIDRSMKTRGLPKAKSHAPEVITSSPLK

SEQ ID NO: 521 - protein, 491 aa, Artificial Sequence
  Thombin-Factor X V196S/R306E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPEEDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 522 - protein, 491 aa, Artificial Sequence
  Thombin-Factor X V196S/K276A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTAETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 523 - protein, 491 aa, Artificial Sequence
  Thombin-Factor X V196S/K276E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTEETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 524 - protein, 491 aa, Artificial Sequence
  Thombin-Factor X V196S/K420E/R424E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLEWIDESMKTRGLPKAKSHAPEVITSSPLK

SEQ ID NO: 525 - protein, 491 aa, Artificial Sequence
  Thombin-Factor X V196S/R273E/K420E/R424E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNEFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLEWIDESMKTRGLPKAKSHAPEVITSSPLK

SEQ ID NO: 526 - protein, 491 aa, Artificial Sequence
  Thombin-Factor X V196S/R273E/R306E/K420E/R424E fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNEFTKETYDFDIAVLRLKTPITFRMNVAPACLPEEDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLEWIDESMKTRGLPKAKSHAPEVITSSPLK

SEQ ID NO: 527 - protein, 491 aa, Artificial Sequence
  Thombin-Factor X V196S/K338A fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLAMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 528 - protein, 491 aa, Artificial Sequence
  Thombin-Factor X V196S/K338S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLSMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 529 - protein, 491 aa, Artificial Sequence
  Thombin-Factor X V196S/E215N/N217S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINNESEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 530 - protein, 491 aa, Artificial Sequence
  Thombin-Factor X V196S/E264N/E266S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 531 - protein, 491 aa, Artificial Sequence
  Thombin-Factor X D119N/G121S/V196S/E264N/E266S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 532 - protein, 491 aa, Artificial Sequence
  Thombin-Factor X G114N/V196S/E264N/E266S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 533 - protein, 491 aa, Artificial Sequence
  Thombin-Factor X V196S/R429N/L431S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTNGSPKAKSHAPEVITSSPLK

SEQ ID NO: 534 - protein, 491 aa, Artificial Sequence
  Thombin-Factor X V196S/R243N/K245S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKNFSVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 535 - protein, 491 aa, Artificial Sequence
  Thombin-Factor X V196S/T293N/R295S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPINFSMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 536 - protein, 491 aa, Artificial Sequence
  Thombin-Factor X V196S/D389N/Y391S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKNTSFVTGIVSWGEGCARKGKYGIYTKVTAFLKWIDRSMKTRGLPKAKSHAPEVITSSPLK

SEQ ID NO: 537 - protein, 491 aa, Artificial Sequence
  Thombin-Factor X V196S/K388N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 538 - protein, 491 aa, Artificial Sequence
  Thombin-Factor X D119N/G121S/V196S/K388N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 539 - protein, 491 aa, Artificial Sequence
  Thombin-Factor X V196S/T428N/G430S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKNRSLPKAKSHAPEVITSSPLK

SEQ ID NO: 540 - protein, 491 aa, Artificial Sequence
  Thombin-Factor X V196S/L211S/G219H/E264N/E266S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 541 - protein, 491 aa, Artificial Sequence
  Thombin-Factor X D119N/G121S/V196S/L211S/G219H/E264N/E266S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 542 - protein, 491 aa, Artificial Sequence
  Thombin-Factor X G114N/V196S/L211S/G219H/E264N/E266S fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 543 - protein, 491 aa, Artificial Sequence
  Thombin-Factor X V196S/E264N/E266S/K388N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQALLINEENEGFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 544 - protein, 491 aa, Artificial Sequence
  Thombin-Factor X D119N/G121S/V196S/L211S/G219H/K388N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLANNSKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 545 - protein, 491 aa, Artificial Sequence
  Thombin-Factor X G114N/V196S/L211S/G219H/K388N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARNYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 546 - protein, 491 aa, Artificial Sequence
  Thombin-Factor X V196S/L211S/G219H/E264N/E266S/K388N fusion polypeptide
MAHVRGLQLPGCLALAALCSLVHSQHVFLAPQQARSLLQRVRRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRISGGQECKDGECPWQASLINEENEHFCGGTILSEFYILTAAHCLYQAKRFKVRVGDRNTEQEEGGEAVHNVSVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFNDTYFVTGIVSWGEGCARKGKYGIYTKVTAFLKWIDRSMKTRGLPKAKSHAPEVITSSPLK

SEQ ID NO: 547 - protein, 488 aa, Homo sapiens
  Factor X natural variant (L7I)
  VARIANT (7)...(7): L to I
  PROPEP (1)...(31): signal peptide
  PROPEP (32)...(40): propeptide
  CHAIN (41)...(488): mature Factor X
  CHAIN (41)...(179): Factor X light chain
  CHAIN (183)...(488): Factor X heavy chain
  PROPEP (183)...(234): activation peptide
  CHAIN (235)...(488): activated Factor Xa heavy chain
MGRPLHIVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 548 - protein, 488 aa, Homo sapiens
  Factor X natural variant (G30H)
  VARIANT (30)...(30): G to H
  PROPEP (1)...(31): signal peptide
  PROPEP (32)...(40): propeptide
  CHAIN (41)...(488): mature Factor X
  CHAIN (41)...(179): Factor X light chain
  CHAIN (183)...(488): Factor X heavy chain
  PROPEP (183)...(234): activation peptide
  CHAIN (235)...(488): activated Factor Xa heavy chain
MGRPLHLVLLSASLAGLLLLGESLFIRREHANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 549 - protein, 488 aa, Homo sapiens
  Factor X natural variant (A152T)
  VARIANT (152)...(152): A to T
  PROPEP (1)...(31): signal peptide
  PROPEP (32)...(40): propeptide
  CHAIN (41)...(488): mature Factor X
  CHAIN (41)...(179): Factor X light chain
  CHAIN (183)...(488): Factor X heavy chain
  PROPEP (183)...(234): activation peptide
  CHAIN (235)...(488): activated Factor Xa heavy chain
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCTRGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 550 - protein, 488 aa, Homo sapiens
  Factor X natural variant (G192R)
  VARIANT (192)...(192): G to R
  PROPEP (1)...(31): signal peptide
  PROPEP (32)...(40): propeptide
  CHAIN (41)...(488): mature Factor X
  CHAIN (41)...(179): Factor X light chain
  CHAIN (183)...(488): Factor X heavy chain
  PROPEP (183)...(234): activation peptide
  CHAIN (235)...(488): activated Factor Xa heavy chain
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSREAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 551 - protein, 485 aa, Homo sapiens
  Factor X variant (KVRV285-288E)
  VARIANT (285)...(288): KVRV285-288 to E
  PROPEP (1)...(31): signal peptide
  PROPEP (32)...(40): propeptide
  CHAIN (41)...(485): mature Factor X
  CHAIN (41)...(179): Factor X light chain
  CHAIN (183)...(485): Factor X heavy chain
  PROPEP (183)...(234): activation peptide
  CHAIN (235)...(485): activated Factor Xa heavy chain
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFEGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 552 - protein, 488 aa, Homo sapiens
  FX variant G192S
  VARIANT (192)...(192): G to S
  PROPEP (1)...(31): signal peptide
  PROPEP (32)...(40): propeptide
  CHAIN (41)...(488): mature Factor X
  CHAIN (41)...(179): Factor X light chain
  CHAIN (183)...(488): Factor X heavy chain
  PROPEP (183)...(234): activation peptide
  CHAIN (235)...(488): activated Factor Xa heavy chain
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGESCARKGKYGIYTKVTAFLKWIDRSMKTRGLPKAKSHAPEVITSSPLK

SEQ ID NO: 553 - protein, 464 aa, Homo sapiens
  Antithrombin III precursor
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 554 - protein, 432 aa, Homo sapiens [sequence omitted]

SEQ ID NO: 555 - protein, 6 aa, Artificial Sequence
  EPR-1 recognition site
LFTRKL

SEQ ID NO: 556 - protein, 245 aa, Homo sapiens
  Chymotrypsinogen B mature
CGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 557 - protein, 304 aa, Homo sapiens
  Tissue factor pathway inhibitor (TFPI)
  ref <308>: DATABASE ACCESSION NUMBER: UniProtKB: P10646
  ref <309>: DATABASE ENTRY DATE: 2013-03-06
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

The invention claimed is:

1. An isolated modified Factor X (FX) polypeptide, comprising amino acid replacements at positions corresponding to positions 196 and 332 in an unmodified FX polypeptide based on mature numbering with reference to amino acid positions set forth in SEQ ID NO:134, wherein:
the amino acid replacement at position 196 is a serine (S) or threonine (T);
the amino acid replacement at position 332 is selected from among amino acid replacement with alanine (A), aspartic acid (D), glutamic acid (E), serine (S) and glycine (G);
the unmodified FX polypeptide has the sequence of amino acids set forth in SEQ ID NO:134, or is the zymogen, active or catalytically active form thereof or has at least 95% sequence identity with the polypeptide whose sequence is set forth in SEQ ID NO:134 or with the zymogen, active or catalytically active form of the polypeptide of SEQ ID NO:134;
corresponding amino acid positions are identified by alignment of the unmodified FX polypeptide with the polypeptide set forth in SEQ ID NO:134;
the modified FX polypeptide, when in active form, exhibits at least 50-fold increased factor Va (FVa) co-factor dependence, and increased resistance to anti-thrombin III (ATIII) compared to the active form of the unmodified FX polypeptide that is the same as the modified FX polypeptide, but does not contain the amino acid replacement(s); and co-factor dependence is assessed by comparing the ratio of FVa-dependent activity/FVa-independent activity of the modified FX polypeptide to that of the unmodified FX polypeptide not containing the modification(s).

2. The modified FX polypeptide of claim 1, wherein the amino acid replacement at the position corresponding to position 196 is serine (S).

3. The modified FX polypeptide of claim 1, wherein the amino acid replacement at the position corresponding to position 332 is alanine (A).

4. The modified FX polypeptide of claim 1 that is an activated FXa polypeptide.

5. A modified Factor X (FX) polypeptide, comprising the sequence of amino acids set forth in any of SEQ ID NOs: 92-96 and 224-228.

6. The modified FX polypeptide of claim 1, wherein co-factor dependence is increased at least 75-fold, 100-fold, 125-fold, 150-fold, 200-fold, 250-fold, 300-fold, 350-fold, 400-fold, 450-fold, 500-fold, 600-fold, 700-fold, 800-fold, 900-fold or 1000-fold compared to the unmodified polypeptide.

7. The modified FX polypeptide of claim 1, comprising only three, four, five, six, seven, eight, nine or ten amino acid replacement(s) compared to the unmodified polypeptide of the same form.

8. The modified FX polypeptide of claim 1, comprising one or more additional replacements selected from:

S at a position corresponding to position 211; D at a position corresponding to position 214; A at a position corresponding to position 214; S at a position corresponding to position 214; Rat a position corresponding to position 216; K at a position corresponding to position 216; A at a position corresponding to position 216; S at a position corresponding to position 216; R at a position corresponding to position 218; K at a position corresponding to position 218; A at a position corresponding to position 218; H at a position corresponding to position 219; A at a position corresponding to position 273; E at a position corresponding to position 273; A at a position corresponding to position 276; E at a position corresponding to position 276; E at a position corresponding to position 306; S at a position corresponding to position 326; T at a position corresponding to position 326; V at a position corresponding to position 326; Q at a position corresponding to position 326; N at a position corresponding to position 326; M at a position corresponding to position 326; K at a position corresponding to position 326; Y at a position corresponding to position 326; E at a position corresponding to position 326; D at a position corresponding to position 326; A at a position corresponding to position 338; S at a position corresponding to position 338; N at a position corresponding to position 338; R at a position corresponding to position 338; V at a position corresponding to position 338; Y at a position corresponding to position 338; M at a position corresponding to position 338; A at a position corresponding to position 420; E at a position corresponding to position 420; A at a position corresponding to position 424; and E at a position corresponding to position 424, with reference to amino acid positions set forth in SEQ ID NO:134, or the same replacement(s) at a corresponding amino acid residue in the unmodified FX polypeptide.

9. A modified FX polypeptide, containing only two amino acid replacements in the polypeptide comprising the sequence of amino acid residues set forth in SEQ ID NO:134, wherein the amino acid replacement(s) are selected from among amino acid replacement(s) with:

S at a position corresponding to position 196 and A at a position corresponding to position 332;

S at a position corresponding to position 196 and D at a position corresponding to position 332;

S at a position corresponding to position 196 and E at a position corresponding to position 332;

S at a position corresponding to position 196 and S at a position corresponding to position 332;

S at a position corresponding to position 196 and G at a position corresponding to position 332;

based on mature numbering with reference to amino acid positions set forth in SEQ ID NO:134 or the same amino acid replacement at a corresponding amino acid residue in the unmodified FX polypeptide.

10. The modified FX polypeptide of claim 1, comprising amino acid replacements with S at a position corresponding to position 196 and A at a position corresponding to position 332.

11. The modified FX polypeptide of claim 1, comprising one or more further amino acid replacements that alters glycosylation by introduction of a non-native glycosylation site.

12. The modified FX polypeptide of claim 11, wherein the non-native glycosylation site is introduced by one or more amino acid replacements selected from among:

N at a position corresponding to position 51;

N at a position corresponding to position 56 and S at a position corresponding to position 58;

N at a position corresponding to position 62 and S at a position corresponding to position 64;

N at a position corresponding to position 65 and S at a position corresponding to position 67;

N at a position corresponding to position 67;

N at a position corresponding to position 73 and S at a position corresponding to position 75;

N at a position corresponding to position 75 and S at a position corresponding to position 77;

N at a position corresponding to position 77 and S at a position corresponding to position 79;
N at a position corresponding to position 78 and S at a position corresponding to position 80;
S at a position corresponding to position 82;
N at a position corresponding to position 83;
N at a position corresponding to position 82 and S at a position corresponding to position 84;
N at a position corresponding to position 85 and S at a position corresponding to position 87;
N at a position corresponding to position 86 and S at a position corresponding to position 88;
N at a position corresponding to position 95 and S at a position corresponding to position 97;
N at a position corresponding to position 114;
N at a position corresponding to position 119 and S at a position corresponding to position 121; S at a position corresponding to position 122;
N at a position corresponding to position 215 and S at a position corresponding to position 217;
N at a position corresponding to position 243 and S at a position corresponding to position 245;
N at a position corresponding to position 264 and S at a position corresponding to position 266;
N at a position corresponding to position 293 and S at a position corresponding to position 295;
N at a position corresponding to position 388;
N at a position corresponding to position 389 and S at a position corresponding to position 391;
N at a position corresponding to position 428 and S at a position corresponding to position 430; and
N at a position corresponding to position 429 and S at a position corresponding to position 431, with reference to amino acid positions set forth in SEQ ID NO:134, or the same replacement(s) at a corresponding amino acid residue in the unmodified FX polypeptide.

13. The modified FX polypeptide of claim 1, wherein the unmodified FX polypeptide is selected from among:
   a) a zymogen FX polypeptide comprising a light chain comprising the sequence of amino acids set forth as residues 1-139 of SEQ ID NO:134, and a heavy chain comprising the sequence of amino acids set forth as residues 143-448 of SEQ ID NO:134;
   b) an active FX (FXa) polypeptide comprising a light chain comprising the sequence of amino acids set forth as residues 1-139 of SEQ ID NO:134, and a heavy chain comprising the sequence of amino acids set forth as residues 195-448 of SEQ ID NO:134; and
   c) a catalytically active form of the polypeptide of b).

14. The modified FX polypeptide of claim 1, comprising a sequence of amino acids selected from among:
   a) a sequence of amino acids set forth in any of SEQ ID NOS: 224-228, or a sequence of amino acids that exhibits at least 95% sequence identity to any of the sequence of amino acids set forth in any of SEQ ID NOS: 224-228 and that contains the amino acid replacement(s);
   b) a sequence of amino acids comprising a light chain comprising the sequence of amino acids set forth as residues 1-139 of SEQ ID NOS: 224-228, and a heavy chain comprising the sequence of amino acids set forth as residues 143-448 of any of SEQ ID NOS: 224-228, or a sequence of amino acids that exhibits at least 95% sequence identity to any of the sequence of amino acids comprising a light chain comprising the sequence of amino acids set forth as residues 1-139 of SEQ ID NOS: 224-228, and a heavy chain comprising the sequence of amino acids set forth as residues 143-448 of any of SEQ ID NOS: 224-228 and that contains the amino acid replacement(s);
   c) a sequence of amino acids comprising a light chain comprising the sequence of amino acids set forth as residues 1-139 of SEQ ID NOS: 224-228, and a heavy chain comprising the sequence of amino acids set forth as residues 195-448 of any of SEQ ID NOS: 224-228, or a sequence of amino acids that exhibits at least 95% sequence identity to any of the sequence of amino acids comprising a light chain comprising the sequence of amino acids set forth as residues 1-139 of SEQ ID NOS: 224-228, and a heavy chain comprising the sequence of amino acids set forth as residues 195-448 of any of SEQ ID NOS: 224-228 and that contains the amino acid replacement(s); and
   d) a catalytically active form of c) that includes the modification(s) and exhibits catalytic activity.

15. The modified FX polypeptide of claim 1 that is a zymogen polypeptide.

16. The modified FX polypeptide of claim 1 that is a two-chain polypeptide or is a single-chain polypeptide.

17. The modified FX polypeptide of claim 1 that is active or activated.

18. A pharmaceutical composition, comprising a modified FX polypeptide of claim 1 in a pharmaceutically acceptable vehicle.

19. The pharmaceutical composition of claim 18 that is formulated for local, systemic or topical administration.

20. The pharmaceutical composition of claim 18 that is formulated for single-dosage administration.

21. A method for treating a bleeding disorder, comprising administering to a subject a pharmaceutical composition of claim 18.

22. The method of claim 21, wherein the bleeding disorder is a congenital bleeding disorder or an acquired bleeding disorder.

23. The method of claim 21, wherein the bleeding disorder is selected from among a disorder due to a deficiency of a coagulation factor, a disorder due to the presence of acquired inhibitors to a coagulation factor, a hematologic disorder, a hemorrhagic disorder, Von Willebrands' disease, a disorder that results from anticoagulant therapy with a vitamin-K antagonist, hereditary platelet disorders, vitamin K epoxide reductase C1 deficiency, gamma-carboxylase deficiency, bleeding associated with trauma, injury, thrombosis, thrombocytopenia, stroke, coagulopathy, disseminated intravascular coagulation (DIC), Bernard Soulier syndrome, Glanzman thromblastemia and storage pool deficiency.

24. The method of claim 23, wherein the bleeding disorder is due to a deficiency of a coagulation factor and the coagulation factor is selected from among factor VII, factor VIII, factor IX, and factor XI.

25. The method of claim 24, wherein the bleeding disorder is selected from among hemophilia A, hemophilia B or hemophilia C.

26. The method of claim 21, further comprising administering one or more additional coagulation factors.

27. The modified FX of claim 1, comprising the sequence of amino acids set forth in any of SEQ ID NOs: 92-96 or a catalytically active form thereof.

28. A modified active Factor X (FXa) polypeptide, comprising an amino acid replacement at position 196 and at position 332 in an unmodified FXa polypeptide based on mature numbering with reference to amino acid positions set forth in SEQ ID NO:134, wherein:

the replacement at position 196 is serine (S), and the replacement at position 332 is selected from among replacement with alanine (A), aspartic acid (D), glutamic acid (E), serine (S) or glycine (G);

the modified FXa polypeptide contains only up to seven amino acid replacements;

the unmodified FXa comprises a light chain consisting of the sequence of amino acids set forth as residues 1-139 of SEQ ID NO:134, and a heavy chain consisting of the sequence of amino acids set forth as residues 195-448 of SEQ ID NO:134;

the modified FXa exhibits at least 50-fold increased FVa cofactor dependence compared to the unmodified FXa polypeptide not containing the amino acid replacements; and co-factor dependence is the ratio of catalytic activity of the modified FXa in the presence of Factor Va (FVa) compared to in the absence of FVa.

29. The modified FXa polypeptide of claim 28, wherein the replacement at position 332 is with alanine (A).

* * * * *

UNITED STATES PATENT AND TRADEMARK OFFICE
CERTIFICATE OF CORRECTION

PATENT NO. : 9,145,552 B2
APPLICATION NO. : 13/815768
DATED : September 29, 2015
INVENTOR(S) : Madison et al.

Page 1 of 2

It is certified that error appears in the above-identified patent and that said Letters Patent is hereby corrected as shown below:

IN THE SPECIFICATION:

In the description of FIG. 3 at column 19, line 51, please replace "FIG. 31" with —FIG. 3I—.

IN THE CLAIMS:

Column 181, line 61, should read,

8. The modified FX polypeptide of claim 1, comprising one or more additional replacements selected from:

S at a position corresponding to position 211; D at a position corresponding to position 214; A at a position corresponding to position 214; S at a position corresponding to position 214; R at a position corresponding to position 216; K at a position corresponding to position 216; A at a position corresponding to position 216; S at a position corresponding to position 216; R at a position corresponding to position 218; K at a position corresponding to position 218; A at a position corresponding to position 218; H at a position corresponding to position 219; A at a position corresponding to position 273; E at a position corresponding to position 273; A at a position corresponding to position 276; E at a position corresponding to position 276; E at a position corresponding to position 306; S at a position corresponding to position 326; T at a position corresponding to position 326; V at a position corresponding to position 326; Q at a position corresponding to position 326; N at a position corresponding to position 326; M at a position corresponding to position 326; K at a position corresponding to position 326; Y at a position corresponding to position 326; E at a position corresponding to position 326; D at a position corresponding to position 326; A at a position corresponding to position 338; S at a position corresponding to position 338; N at a position corresponding to position 338; R at a position corresponding to position 338; V at a position Signed and Sealed this
Tenth Day of May, 2016

Michelle K. Lee
*Director of the United States Patent and Trademark Office*

CERTIFICATE OF CORRECTION (continued)
U.S. Pat. No. 9,145,552 B2 corresponding to position 338; Y at a position corresponding to position 338; M at a position corresponding to position 338; A at a position corresponding to position 420; E at a position corresponding to position 420; A at a position corresponding to position 424; and E at a position corresponding to position 424, with reference to amino acid positions set forth in SEQ ID NO:134, or the same replacement(s) at a corresponding amino acid residue in the unmodified FX polypeptide.